United States Patent
Lawrence (10) Patent No.: US 10,968,258 B2
(45) Date of Patent: Apr. 6, 2021

(54) STREPTOCOCCUS SUIS VACCINES TO PROTECT AGAINST REPRODUCTIVE, NURSERY-AGE, AND GROWING PIG DISEASES AND METHODS OF MAKING AND USE THEREOF

(71) Applicant: BOEHRINGER INGELHEIM ANIMAL HEALTH USA INC., Duluth, GA (US)

(72) Inventor: Paulraj Lawrence, Arden Hills, MN (US)

(73) Assignee: BOEHRINGER INGELHEIM ANIMAL HEALTH USA INC., Duluth, GA (US)

( * ) Notice: Subject to any disclaimer, the term of this patent is extended or adjusted under 35 U.S.C. 154(b) by 0 days.

(21) Appl. No.: 16/118,857

(22) Filed: Aug. 31, 2018

(65) Prior Publication Data

US 2019/0241625 A1 Aug. 8, 2019

Related U.S. Application Data

(60) Provisional application No. 62/552,975, filed on Aug. 31, 2017.

(51) Int. Cl.
| | | |
|---|---|---|
| *C07K 14/315* | (2006.01) | |
| *A61K 39/09* | (2006.01) | |
| *A61K 39/39* | (2006.01) | |
| *A61K 39/00* | (2006.01) | |
| *C12Q 1/6869* | (2018.01) | |
| *G16B 30/00* | (2019.01) | |
| *G16B 50/00* | (2019.01) | |
| *C40B 40/08* | (2006.01) | |

(52) U.S. Cl.
CPC .......... *C07K 14/315* (2013.01); *A61K 39/092* (2013.01); *A61K 39/39* (2013.01); *A61K 2039/552* (2013.01); *C12Q 1/6869* (2013.01); *C40B 40/08* (2013.01); *G16B 30/00* (2019.02); *G16B 50/00* (2019.02)

(58) Field of Classification Search
None
See application file for complete search history.

(56) References Cited

U.S. PATENT DOCUMENTS 10,279,031 B2 * 5/2019 Weaver ................. A61K 39/145

FOREIGN PATENT DOCUMENTS

| EP | 2 949 340 A1 | 12/2015 |
| WO | WO 2007/025390 A1 | 3/2007 |
| WO | WO 2014/004361 A1 | 1/2014 |

OTHER PUBLICATIONS

Ellis (Vaccines, W.B. Saunders Company, Chapter 29, 1988, pp. 568-574).*
Boslego et al (Vaccines and Immunotherapy, 1991, Chapter 17).*
Skolnick et al. (Trends in Biotechnology 18: 34-39, 2000).*
Baums, C. G., et. al., 2006. Identification of a novel virulence determinant with serum opacification activity in S. suis. Infect. Immun. 74, 6154-6162.
Baums, C.G., et.al., 2009. S. suis bacterin and subunit vaccine immunogenicities and protective efficacies against serotypes 2 and 9.Clin Vacc Immunol. 2, 200-208.
Berthelot-Herault, F., et. al., 2005. Dilemma of virulence of S. suis: Canadian isolate 89-1591 characterized as a virulent strain using a standardized experimental model in pigs. Can. J. Vet. Res. 69, 236-240.
Chabot-Roy, G., Willson, P., Segura, M., Lacouture, S., Gottschalk, M., 2006. Phagocytosis and killing of Sreptococcus suis by porcine neutrophils. Microb. Pathog. 41, 21-32.
Edholm V, et al.: Fratricide in Streptococcus pneumoniae: contributions and role of the cell wall hydrolases CbpD, LytA and LytC. Microbiology., 2009, 155:2223-2234.
Gottschalk M, et.a.,. Characterization of six new capsular types (23 through 28) of Streptococcus suis. J Clin Microbiol. Nov. 29, 1991(11):2590-4.
Higgins R, Gottschalk M, Boudreau M, Lebrun A, Henrichsen J: Description of six new capsular types (29-34) of Streptococcus suis. J Vet Diagn Invest., 1995, 7:405-406.
Higgins R, Gottschalk M Distribution of Streptococcus suis capsular types in 1998. Can Vet J. Apr. 1999;40(4):277.
Higgins, R., Gottschalk, M., 2006. Streptococcal diseases. In: Straw, B.E., et. al., (Eds), Diseases of Swine. Blackwell Publishing, pp. 769-783
Hill JE, et al.: Biochemical analysis, cpn60 and 16S rDNA sequence data indicate that S. suis serotypes 32 and 34, from pigs, are S. orisratti. Vet Microbiol., 2005, 107:63-69.
Hu P, Yang M, Zhang A, Wu J, Chen B, Hua Y, Yu J, Chen H, Xiao J, Jin M. Complete genome sequence of Streptococcus suis serotype 3 strain ST3, J. Bacteriol. 193 (2011) 3428-3429.

(Continued)

*Primary Examiner* — Robert A Zeman
(74) *Attorney, Agent, or Firm* — Suzanne Seavello Shope; John Ezcurra (57) ABSTRACT

The present invention provides *S. suis* strains that elicit an immune response in animal *S. suis*, compositions comprising said strains, methods of vaccination against *S. suis*, and kits for use with such methods and compositions. The invention further provides a comprehensive, unambiguous method of capsular typing based on whole genome sequencing and bioinformatics. This capsular typing approach can accurately identify serotypes even when strains possess novel capsular loci and can be used to determine which strains to include when formulating vaccines, including herd specific vaccines.

10 Claims, 6 Drawing Sheets

Specification includes a Sequence Listing.

(56) References Cited

OTHER PUBLICATIONS

Hu P, Yang M, Zhang A, Wu J, Chen B, Hua Y, Yu J, Xiao J, Jin M. Complete genome sequence of *Streptococcus suis* serotype 14 strain JS14, J. Bacteriol. 193 (2011) 2375-2376

Okura M, et. al., Genetic analysis of capsular polysaccharide synthesis gene clusters from all serotypes of *Streptococcus suis*: potential mechanisms for generation of capsular variation. Appl Environ Microbiol. Apr. 2013;79 (8):2796-806.

Pan Z, et al.: Novel variant serotype of *S. suis* isolated from piglets with meningitis. Appl. Environ. Microbiol., 2015, 81:976-985.

Quessy, S., et. al., 1995. Discrimination of virulent and avirulent *Streptococcus suis* capsular type 2 isolates from different geographical origins. Infect. Immun. 63, 1975-1979.

Qiu Z, et al.: Novel capsular polysaccharide loci and new diagnostic tools for high-throughput capsular gene typing in *S. suis*. Appl. Environ. Microbiol., 2016, 21:7102-7112.

Smith, H.E., et. al., 1999. Identification and characterization of the cps locus of *S. suis* serotype 2: the capsule protects agnst phagocytosis and is an important virulence factor. Infect. Immun 67, 1750-56.

Smith HE, et.al., The cps genes of *Streptococcus suis* serotypes 1, 2, and 9: development of rapid serotype-specific PCR assays. J Clin Microbiol 1999, 37(10):3146-3152.

Tien LHT, et al: Reappraisal of the taxonomy of *S. suis* serotypes 20, 22, 26, and 33 based on DNA-DNA homology and sodA and recN phylogenies. Vet Microbiol., 2013, 162:842-849.

Vecht, U., Wisselink, H.J., Jellema, M.L., Smith, H.E., 1991. Identification of two proteins associated with virulence of *S. suis* type 2. Infect. Immun. 59, 3156-3162.

Vecht, U., et.al., 1992. Virulence of *Streptococcus suis* type 2 strains in newborn germfree pigs depends on phenotype. Infect. Immun. 60, 550-556.

Wang K, Fan W, Cai L, Huang B, Lu C. Genetic analysis of the capsular polysaccharide synthesis locus in 15 *S. suis* serotypes. FEMS Microbiol Lett. Nov. 2011;324(2):117-24.

Wei Z, et.al., Characterization of *S. suis* isolates from the diseased pigs in China between 2003 and 2007. Vet Microbiol 2009, 137(1-2):196-201.

Zhang A, et. al., Comparative genomic analysis of *S. suis* reveals significant genomic diversity among different serotypes. Oct. 25, 2011;12:523.

Zheng H, et al.: Eight novel capsular polysaccharide synthesis gene loci identified in nontypeable *Streptococcus suis* isolates. Appl. Environ. Microbiol., 2015, 81:4111-4119.

Brockmeier, S. L., et. al., 2017, Use of proteins identified through a functional genomic screen to develop a protein subunit vaccine that provides significant protection against virulent *Streptococcus suis* in pigs. Infection and Immun. vol. 86, No. 3.

Database Protein Online XP0002786302, "nucleotide sugar synthetase-like protein [*Streptococcus suis*]", Aug. 10, 2015; retrieved from NCBI, accession No. WP_050571188.

Database Protein Online XP0002786303, "Glycosyltransferase family 2 protein [*Streptococcus suis*]", Jul. 4, 2017; retrieved from NCBI, accession No. WP_044676816.

Database Protein Online XP0002786304, "accessory Sec system protein translocase subunit SecY2 [*Streptococcus suis*]", Nov. 29, 2015; retrieved from NCBI, accession No. WP_044766479.

Givens D., et. al., Aug. 1, 2008, Infectious causes of embryonic and fetal mortality. Theriogenology. vol. 70, No. 3, pp. 270-285.

Segura M., et. al., Oct. 15, 2015. *Streptococcus suis* vaccines: candidate antigens and progress. Expert Review of Vaccines, vol. 14, No. 12, pp. 1587-1608.

\* cited by examiner

| Isolate | Tissue of Origin | Cps 27% Locus Coverage | Cps 12% Locus Coverage |
|---|---|---|---|
| 17SP1 | Vaginal | 40.6 | 42.5 |
| 17SP2 | Vaginal | 39.4 | 38.6 |
| 17SP3 | Liver | 28.2 | - |
| 17SP4 | Spleen | 23.9 | - |
| 17SP5 | Nasal Swab | 42.5 | - |
| 16HCP1 | Heart | 66.0 | - |
| 16HCP2 | Brain | 88.2 | - |
| 17NPL1 | Laryngeal Swab | 43.1 | - |

| Isolate | PCR | WGS | Agglutination |
|---|---|---|---|
| 14CF1 | Not Typeable | 3 (85%) | Not Typeable |
| 14CF2 | Not Typeable | 10 (83.8%) | Not Typeable |
| 14CF3 | Not Typeable | 3 (85.8%) | Not Typeable |
| 14CF4 | 2 | 1/2 (96.7%) | 2 |
| 14CF5 | 9 | 9 (59.4%) | 9 |
| 14CF6 | Not Typeable | 3 (84.5%) | Not Typeable |
| 14CF7 | Not Typeable | 3 (99.8%) | 3 |
| 14CF8 | 7 | 7 (99.6%) | 7 |
| 14CF9 | Not Typeable | 23 (72.5%) | 23 |
| 14CG1 | 2 | 2 (88.9%) | 1/2 |
| 14CG2 | 2 | 2 (93.0%) | 1/2 |
| 14CG3 | 2 | 2 (93.0%) | 1/2 |
| 14CG4 | 2 | 2 (93.0%) | 1/2 |
| 14CG5 | 2 | 2 (93.0%) | 1/2 |

STREPTOCOCCUS SUIS VACCINES TO PROTECT AGAINST REPRODUCTIVE, NURSERY-AGE, AND GROWING PIG DISEASES AND METHODS OF MAKING AND USE THEREOF

CROSS-REFERENCE TO RELATED APPLICATIONS

This application claims priority to U.S. provisional application No. 62/552,975, filed 31 Aug. 2017, and incorporated herein by reference in its entirety.

INCORPORATION BY REFERENCE

Any foregoing applications and all documents cited therein or during their prosecution ("application cited documents") and all documents cited or referenced in the application cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. Citation or identification of any such document in this application is not an admission that such document is available as prior art to the present invention and does not reflect any view of the validity, patentability and/or enforceability of such cited patent documents. All sequences referenced herein by GenBank Accession numbers are herein incorporated by reference in their entirety, and said sequences are as set forth in GenBank at as of the filing date of the present application.

FIELD OF THE INVENTION

The present invention relates generally to bacterial vaccines, particularly those providing safe, and effective protection to porcines against reproductive, nursery-age, and growing pig disease caused by a newly identified strain of *Streptococcus suis*. The invention further relates to methods of producing the bacteria, and to the identification of nucleic acid variations that are associated with a novel capsular structure, the cbpD gene, and an alternative secretory pathway which may confer upon these strains a unique ability to colonize the vaginal tract and provide a competitive advantage against other strains. The invention accordingly relates to immunogenic or vaccine compositions comprising the bacteria of the invention; e.g., live, attenuated or killed bacteria. The invention further relates to methods for preparing and/or formulating such compositions. The invention further relates to a comprehensive, unambiguous method of capsular typing based on whole genome sequencing and bioinformatics. This capsular typing approach can accurately identify serotypes even when strains possess novel capsular loci and can be used to determine which strains to include when formulating vaccines, including herd specific vaccines.

STATEMENT REGARDING SEQUENCE LISTING

The Sequence Listing associated with this application is provided in text format in lieu of a paper copy, and is hereby incorporated by reference into the specification. The name of the text file containing the Sequence Listing is MER 17-323 ST25.txt. The text file is 1,565 KB; it was created on 30 Aug. 2018; and it is being submitted electronically via EFS-Web, concurrent with the filing of the specification.

BACKGROUND OF THE INVENTION

*Streptococcus suis* is a Gram positive cocci that predominantly colonizes pigs. While the adult pigs serve as asymptomatic carries, it can cause fatal meningitis, septicemia arthritis and bronchopneumonia in piglets. Adult pigs usually carry *S. suis* as commensal in their tonsillar crypts and upper respiratory tracts, but bacteria have also been isolated from the gastrointestinal and genital tracts. Almost all the adult pigs serve as reservoirs for *S. suis* and this pathogen affects pig industries worldwide.

*Streptococcus suis* can also cause abortions in infected sows (Givens M D, Marley M S: Infectious causes of embryonic and fetal mortality. Theriogenology, 2008, 70:270-285). Based on agglutination tests, 35 different serotypes of *S. suis* have been identified to date (Higgins R, Gottschalk M, Boudreau M, Lebrun A, Henrichsen J: Description of six new capsular types (29-34) of *Streptococcus suis*. J Vet Diagn Invest., 1995, 7:405-406); however, recent work suggests that six of the original serotypes are new species (Hill J E, et al.: Biochemical analysis, cpn60 and 16S rDNA sequence data indicate that *Streptococcus suis* serotypes 32 and 34, isolated from pigs, are *Streptococcus orisratti*. Vet Microbiol., 2005, 107:63-69; Tien L H T, et al: Reappraisal of the taxonomy of *Streptococcus suis* serotypes 20, 22, 26, and 33 based on DNA-DNA homology and sodA and recN phylogenies. Vet Microbiol., 2013, 162:842-849). *S. suis* is a common resident of the reproductive tract of sows. However, it is also an opportunistic pathogen and is occasionally isolated from sows exhibiting symptoms of vaginal discharge and endometritis (Torremorrell M. Bacterial, rickettsial, protozoal, and fungal causes of infertility and abortion in swine: In Youngquist R S, Threlfall W R, editors. Current therapy in large animal theriogenology. 2nd ed., St. Louis: Elsevier; 2007, 794-801).

The first description of streptococcal infection is attributed to the Austrian surgeon, Theodor Billroth in 1874 (Billroth, 1874; Billroth, 1877). Additional refinement of the name *Streptococcus* came from Friedrich Julius Rosenbach in 1884, who examined bacteria isolated from suppurative lesions, and began naming species (Evans, 1936). The introduction of blood agar plates by Hugo Schottmuller in 1903 was an important step forward for the differentiation of streptococci (Schottmuller, 1903; Becker, 1916). In 1933, Lancefield used surface antigen differences among various streptococci to further subdivide them into groups designated by the letters A through X (Kohler, 2008). The strains from human diseases were classified as Group A; the strains from bovine and dairy sources as Group B; the strains from a variety of animal sources as Group C; and so forth. For epidemiological studies, the determination of the T-antigens by slide agglutination was introduced by Fred Griffith of London in 1934 (Griffith, 1934) (Kohler, 1974). More recent descriptions of the "present state of species within the genus *Streptococcus* and *Enterococcus*" by Kohler (Kohler, 2007), and a "phylogenomic analysis of genome evolution in the genus *Streptococcus*" by Richards et al. (Richards, et al., 2014) provide important new overviews of the genus *Streptococcus*. Complete citations can be found at ncbi.nlm.nih.gov/books/NBK333430.

With respect to Streptococcal animal strains, there has been much less progress in classification. There are 35 known serotypes of *S. suis* based on the antigenic differences of the capsular polysaccharide. Some researchers consider that there are only 29 unique serotypes, excluding numbers 20, 22, 26, 33, 32 and 34 (FIG. 7). Serotype 2 (ST2) is most prevalent in North America and Europe followed by serotypes 3 and ½.

The two known methods of identification described above each only identify a portion of the 35 known species (FIG. 6). Thus there has been a long-felt in animal husbandry for a more comprehensive type of serotyping. The newly derived method described herein fills this need.

Whole cells and numerous *S. suis* proteins have been investigated as potential vaccine candidates. Immunization with a wild type bacterin completely protected against challenge with the homologous serotype while non-encapsulated mutant failed to afford protection [Wisselink et al., 2002]. In a study conducted by Li et al, recombinant SAO (*S. suis* surface protein) in combination with Quil A protected against *S. suis* serotype 2 disease in pigs. Intramuscular immunization with SAO elicited significant humoral antibody responses, but were predominantly IgG2. Recombinant SAO immunization also induced opsonophagocytic antibodies [Li, Yuanyi, et al. "Immunization with Recombinant Sao Protein Confers Protection against *Streptococcus Suis* Infection." *Clinical and Vaccine Immunology*, American Society for Microbiology, 1 Aug. 2007, cvi.asm.org/content/14/8/937]. Immunization of piglets with purified suilysin from *S. suis* strain P1/7 (serotype 2), increased neutralizing antibody titers suggesting that SLY might function as protective antigen [Jacobs, A. A. C., et al. "Protection of Experimentally Infected Pigs by Suilysin, the Thiol-Activated Haemolysin of *Streptococcus suis." Veterinary Record*, British Medical Journal Publishing Group, 7 Sep. 1996, veterinaryrecord.bmj.com/content/139/10/225]. However, none of these experiments used heterologous serotypes to challenge pigs vaccinated with these antigens. In a study by Baums et al, *S. suis*, serotype 2 bacterin induced protective immunity against homologous challenge. In contrast, the protective efficacy of the MAP subunit vaccine was low, although MAP immunization resulted in high serum IgG2 titers against MRP and SAO. Importantly, immunization with bacterin but not with MAP induced opsonizing antibody titers against the serotype 2 strain, and these antibody titers were found to correlate with protection. However, after absorption with a non-encapsulated isogenic mutant, the sera from bacterin-immunized piglets failed to facilitate neutrophil killing, indicating that antibodies directed against capsule may not have been essential for opsonophagocytosis [Baums, Christoph Georg, et al. "*Streptococcus Suis* Bacterin and Subunit Vaccine Immunogenicities and Protective Efficacies against Serotypes 2 and 9." *Clinical and Vaccine Immunology*, American Society for Microbiology, 1 Feb. 2009, cvi.asm.org/content/16/2/200]. Furthermore, induction of opsonizing antibodies against serotype 9 was not detectable in the group receiving bacterin or in the group receiving the MAP vaccine, resulting in low protection against serotype 9 strains.

Lack of an effective vaccine against *S. suis* reproductive, nursery-age, and growing pig disease is a new problem in modern swine production.

SUMMARY OF THE INVENTION

Thus, it a primary object of the instant disclosure to provide a safe and effective *S. suis* vaccine against reproductive, nursery-age, and growing pig diseases.

The invention further provides methods for inducing an immunological (or immunogenic) or protective response against *S. suis* reproductive, nursery-age, or growing pig/swine diseases. An object of this invention is to provide vaccines as well as methods for treatment and prophylaxis of reproductive, nursery-age, and growing pig disease by a new strain of *S. suis* which has been identified as an abortifacient agent.

The present invention further relates to immunogenic regions of new strains of *S. suis*, which provide safe, and effective protective immunity against reproductive disease. Relative to a parent *S. suis* strain, the strains may have one or more capsular variants, whose presence is associated with a unique ability to colonize the vaginal tract and provide a competitive advantage against other strains.

The invention accordingly relates to immunogenic or vaccine compositions comprising the bacteria of the invention; e.g., live, attenuated or killed bacteria.

In a particular embodiment, the newly discovered strains have a highly divergent serotype with some similarity to serotypes 27 and 12 (FIG. 3).

According to one particular embodiment, the strains may have "alternative forms of genes", which are defined herein as "alleles", relative to their parent *S. suis* strain. In an embodiment, the alternative alleles are responsible for reduced virulence.

According to another aspect, the present invention relates to two operons that contribute to the pathology associated with these strains by serving as host-cell adhesins. The first is an alternative secretory operon the second operon is a set of capsular genes that are involved in phosphorylcholine metabolism.

According to another aspect, the newly identified strains possess a lytic choline binding protein D homolog (cbpD). This protein functions differently in strain with a competent export system.

The invention therefore further relates to methods for preparing and/or formulating such compositions; e.g., culturing or growing or propagating the bacteria on or in suitable medium, harvesting the bacteria, optionally killing, inactivating or attenuating the bacteria, and optionally admixing the bacteria with a suitable veterinarily or pharmaceutically acceptable carrier, excipient, diluent or vehicle and/or an adjuvant and/or stabilizer. Thus, the invention also relates to the use of the bacteria in formulating such compositions.

Also disclosed are methods for preventing or treating *S. suis* reproductive, nursery-age, and growing pig/swine diseases, or reproductive, nursery-age, and growing pig/swine disease state(s) caused by *S. suis*, comprising administering the bacteria, which can be live, killed, attenuated, or inactivated, or an immunogenic region thereof; or a composition comprising the live, killed, attenuated, or inactivated bacteria, or an immunogenic region of the bacteria to animals in need thereof.

It is another object of the invention to provide a comprehensive, unambiguous method of capsular typing based on whole genome sequencing and bioinformatics that can accurately identify serotypes even when strains possess novel capsular loci.

It is a further object of the present invention to use this method of capsular typing to determine which strains to include when formulating vaccines, including herd specific vaccines.

In one embodiment, the vaccines further comprise an adjuvant. The adjuvant may be any substance which increases and/or augments the elicited immune response, as compared to vaccine alone. Mucosal adjuvants, including chitosans and derivatives thereof, are particularly useful for the disclosed oral vaccines.

In a further embodiment the present invention comprises using this method of capsular typing to determine which strains to include when formulating vaccines, including herd specific vaccines. It is another object of the invention to provide kits comprising live, killed, attenuated, or inactivated bacteria, or an immunogenic region of the bacteria of at least the newly identified *S. suis* strain and instructions for use to prevent or treat reproductive, nursery-age, and growing pig/swine disease.

It is another object of the invention to provide kits for performing metagenomics analysis of new strains of *S. suis*.

It is another object of the invention to provide kits for preparing vaccines to any serotype discovered in metagenomics analysis.

These and other embodiments are disclosed or are obvious from, and encompassed by, the following Detailed Description.

BRIEF DESCRIPTION OF THE DRAWINGS

A full and enabling disclosure of the present invention, including the best mode thereof, to one of ordinary skill in the art, is set forth more particularly in the remainder of the specification, including reference to the accompanying figures, wherein:

FIG. 2 shows metagenomic analysis—representative phylum level results from vaginal swabs; 2a in normal sows and 2b in aborting sows with vaginal discharge.

DETAILED DESCRIPTION OF THE INVENTION

The present invention provides nucleotide sequences and genes involved in identifying *Streptococcus suis* (*S. suis*), products (e.g., proteins, antigens, immunogens, epitopes) encoded by the nucleotide sequences, methods for producing such nucleotide sequences, products, micro-organisms, and uses therefor, such as for preparing vaccine or immunogenic compositions or for eliciting an immunological or immune response or as a vector, e.g., as an expression vector (for instance, an in vitro or in vivo expression vector).

In particular, the present invention encompasses new *S. suis* strains and vaccines comprising the same, which elicit an immunogenic response in an animal, particularly the *S. suis* strains that elicit, induce or stimulate a response in a porcine. The protocols of the invention protect the animal from *S. suis* and/or prevent disease progression in an infected animal.

In an embodiment, the strains comprise nucleic acid sequences having at least 70%, at least 80%, or at least 90% identity to a sequences as set forth in SEQ ID NO comprising the nucleotides as set forth in SEQ ID NO: 1, 3, 5, 7, 9, 11, 13, 15, 17, 19, 21, 23, 25, 27, 29, or 31; or a conservative variant (or at least 70%, at least 80%, or at least 90% identity) of the polypeptide having the sequence as set forth in SEQ ID NO:2, 4, 6, 8, 10, 12, 14, 16, 18, 20, 22, 24, 26, 28, 30 or 32; or a combination thereof.

In an embodiment, the strains comprise nucleic acid sequences having at least 70%, at least 80%, or at least 90% identity to the nucleotides as set forth in SEQ ID NOs:3, 7, and 11, or combinations thereof. In another embodiment, the *S. suis* strains comprise nucleic acids encoding peptides having a concervative variant (or at least 70%, at least 80%, or at least 90% identity) of the sequence as set forth in SEQ ID NOs:4, 8, 12 or combinations thereof.

In another aspect, the novel *S. suis* strains are formulated into safe, effective vaccine against *S. suis* and infections/diseases caused by *S. suis*.

In an embodiment, the *S. suis* vaccines further comprise an adjuvant. In a particular embodiment, the adjuvant is a mucosal adjuvant, such as chitosan, methylated chitosan, trimethylated chitosan, or derivatives or combinations thereof.

In an embodiment, the adjuvant comprises whole bacteria and/or viruses, including *H. parasuis, clostridium*, swine influenza virus (SIV), porcine circovirus (PCV), porcine reproductive and respiratory syndrome virus (PRRSV), *Mannhemia, Pasteurella, Histophious, Salmonella, Escherichia coli*, or combinations and/or variations thereof. In several embodiments, the adjuvant increases the animal's production of IgM, IgG, IgA, and/or combinations thereof.

By "antigen" or "immunogen" or "immunogenic region" means a substance that induces a specific immune response in a host animal. The antigen may comprise a whole organism, killed, or live; a subunit or portion of an organism; a recombinant vector containing an insert with immunogenic properties; a piece or fragment of DNA capable of inducing an immune response upon presentation to a host animal; a polypeptide, an epitope, a hapten, or any combination thereof. Alternately, the immunogen or antigen may comprise a toxin or antitoxin.

The terms "protein", "peptide", "polypeptide" and "polypeptide fragment" are used interchangeably herein to refer to polymers of amino acid residues of any length. The polymer can be linear or branched, it may comprise modified amino acids or amino acid analogs, and it may be interrupted by chemical moieties other than amino acids. The terms also encompass an amino acid polymer that has been modified naturally or by intervention; for example disulfide bond formation, glycosylation, lipidation, acetylation, phosphorylation, or any other manipulation or modification, such as conjugation with a labeling or bioactive component.

The term "immunogenic or antigenic polypeptide" as used herein includes polypeptides that are immunologically active in the sense that once administered to the host, it is able to evoke an immune response of the humoral and/or cellular type directed against the protein. Preferably the protein fragment is such that it has substantially the same immunological activity as the total protein. Thus, a protein fragment according to the invention comprises or consists essentially of or consists of at least one epitope or antigenic determinant. An "immunogenic" protein or polypeptide, as used herein, includes the full-length sequence of the protein, analogs thereof, or immunogenic fragments thereof. By "immunogenic fragment" is meant a fragment of a protein which includes one or more epitopes and thus elicits the immunological response described above. Such fragments can be identified using any number of epitope mapping techniques, well known in the art. See, e.g., Epitope Mapping Protocols in Methods in Molecular Biology, Vol. 66 (Glenn E. Morris, Ed., 1996). For example, linear epitopes may be determined by e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al., 1984; Geysen et al., 1986. Similarly, conformational epitopes are readily identified by determining spatial conformation of amino acids such as by, e.g., x-ray crystallography and 2-dimensional nuclear magnetic resonance. See, e.g., Epitope Mapping Protocols, supra. Methods especially applicable to the proteins of T. parva are fully described in PCT/US2004/022605 incorporated herein by reference in its entirety.

The term "field strains" as used herein includes samples collected in any area where sows and growing pigs are found, such as in a farm environment or in the wild.

As discussed herein, the invention encompasses active fragments and variants of the antigenic polypeptide. Thus, the term "immunogenic or antigenic polypeptide" further contemplates deletions, additions and substitutions to the sequence, so long as the polypeptide functions to produce an immunological response as defined herein. The term "conservative variation" denotes the replacement of an amino acid residue by another biologically similar residue, or the replacement of a nucleotide in a nucleic acid sequence such that the encoded amino acid residue does not change or is another biologically similar residue. In this regard, particularly preferred substitutions will generally be conservative in nature, i.e., those substitutions that take place within a family of amino acids. For example, amino acids are generally divided into four families: (1) acidic—aspartate and glutamate; (2) basic—lysine, arginine, histidine; (3) non-polar—alanine, valine, leucine, isoleucine, proline, phenylalanine, methionine, tryptophan; and (4) uncharged polar—glycine, asparagine, glutamine, cystine, serine, threonine, tyrosine. Phenylalanine, tryptophan, and tyrosine are sometimes classified as aromatic amino acids. Examples of conservative variations include the substitution of one hydrophobic residue such as isoleucine, valine, leucine or methionine for another hydrophobic residue, or the substitution of one polar residue for another polar residue, such as the substitution of arginine for lysine, glutamic acid for aspartic acid, or glutamine for asparagine, and the like; or a similar conservative replacement of an amino acid with a structurally related amino acid that will not have a major effect on the biological activity. Proteins having substantially the same amino acid sequence as the reference molecule but possessing minor amino acid substitutions that do not substantially affect the immunogenicity of the protein are, therefore, within the definition of the reference polypeptide. All of the polypeptides produced by these modifications are included herein. The term "conservative variation" also includes the use of a substituted amino acid in place of an unsubstituted parent amino acid provided that antibodies raised to the substituted polypeptide also immunoreact with the unsubstituted polypeptide.

The term "epitope" refers to the site on an antigen or hapten to which specific B cells and/or T cells respond. The term is also used interchangeably with "antigenic determinant" or "antigenic determinant site". Antibodies that recognize the same epitope can be identified in a simple immunoassay showing the ability of one antibody to block the binding of another antibody to a target antigen.

An "immunological response" to a composition or vaccine is the development in the host of a cellular and/or antibody-mediated immune response to a composition or vaccine of interest. Usually, an "immunological response" includes but is not limited to one or more of the following effects: the production of antibodies, B cells, helper T cells, and/or cytotoxic T cells, directed specifically to an antigen or antigens included in the composition or vaccine of interest. Preferably, the host will display either a therapeutic or protective immunological response such that resistance to new infection will be enhanced and/or the clinical severity of the disease reduced. Such protection will be demonstrated by either a reduction or lack of symptoms and/or clinical disease signs normally displayed by an infected host, a quicker recovery time and/or a lowered viral titer in the infected host.

The immunological response against S. suis reproductive, nursery-age, and growing pig diseases can be generated by administering the bacteria, which can be live, killed, attenuated, or inactivated, or administering an immunogenic region thereof; or a composition comprising the live, killed, attenuated, or inactivated bacteria, or an immunogenic region of the bacteria to animals.

By "animal" is intended mammals, birds, and the like. Animal or host as used herein includes mammals and human. The animal may be selected from the group consisting of equine (e.g., horse), canine (e.g., dogs, wolves, foxes, coyotes, jackals), feline (e.g., lions, tigers, domestic cats, wild cats, other big cats, and other felines including cheetahs and lynx), ovine (e.g., sheep), bovine (e.g., cattle), porcine (e.g., pig, swine), avian (e.g., chicken, duck, goose, turkey, quail, pheasant, parrot, finches, hawk, crow, ostrich, emu and cassowary), primate (e.g., prosimian, tarsier, monkey, gibbon, ape), ferrets, seals, and fish. The term "animal" also includes an individual animal in all stages of development, including newborn, embryonic and fetal stages.

Unless otherwise explained, all technical and scientific terms used herein have the same meaning as commonly understood by one of ordinary skill in the art to which this disclosure belongs. The singular terms "a", "an", and "the" include plural referents unless context clearly indicates otherwise. Similarly, the word "or" is intended to include "and" unless the context clearly indicate otherwise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

Compositions

The present invention relates to a S. suis vaccine or composition which may comprise an S. suis strain and a pharmaceutically or veterinarily acceptable carrier, excipient, or vehicle, which elicits, induces or stimulates a response in an animal.

The term "nucleic acid" and "polynucleotide" refers to RNA or DNA that is linear or branched, single or double stranded, or a hybrid thereof. The term also encompasses RNA/DNA hybrids. The following are non-limiting examples of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes and primers. A polynucleotide may comprise modified nucleotides, such as methylated nucleotides and nucleotide analogs, uracyl, other sugars and linking groups such as fluororibose and thiolate, and nucleotide branches. The sequence of nucleotides may be further modified after polymerization, such as by conjugation, with a labeling component. Other types of modifications included in this definition are caps, substitution of one or more of the naturally occurring nucleotides with an analog, and introduction of means for attaching the polynucleotide to proteins, metal ions, labeling components, other polynucleotides or solid support. The polynucleotides can be obtained by chemical synthesis or derived from a microorganism.

The term "gene" is used broadly to refer to any segment of polynucleotide associated with a biological function. Thus, genes include introns and exons as in genomic sequence, or just the coding sequences as in cDNAs and/or the regulatory sequences required for their expression. For example, gene also refers to a nucleic acid fragment that expresses mRNA or functional RNA, or encodes a specific protein, and which includes regulatory sequences. "Gene" shall also encompass both coding and non-coding sequences (i.e. upstream and downstream regulatory sequences, promoters, 5'/3' UTR, introns, and exons). Where reference to only a gene's coding sequence is intended, the term "gene's coding sequence" or "CDS" will be used interchangeably throughout this disclosure.

An "isolated" biological component (such as a nucleic acid or protein or organelle) refers to a component that has been substantially separated or purified away from other biological components in the cell of the organism in which the component naturally occurs, for instance, other chromosomal and extra-chromosomal DNA and RNA, proteins, and organelles. Nucleic acids and proteins that have been "isolated" include nucleic acids and proteins purified by standard purification methods. The term also embraces nucleic acids and proteins prepared by recombinant technology as well as chemical synthesis.

The term "conservative variation" denotes the replacement of an amino acid residue by another biologically similar residue, or the replacement of a nucleotide in a nucleic acid sequence such that the encoded amino acid residue does not change or is another biologically similar residue. In this regard, particularly preferred substitutions will generally be conservative in nature, as described above.

The term "recombinant" means a polynucleotide with semisynthetic, or synthetic origin which either does not occur in nature or is linked to another polynucleotide in an arrangement not found in nature.

"Heterologous" means derived from a genetically distinct entity from the rest of the entity to which it is being compared. For example, a polynucleotide may be placed by genetic engineering techniques into a plasmid or vector derived from a different source, and is a heterologous polynucleotide. A promoter removed from its native coding sequence and operatively linked to a coding sequence other than the native sequence is a heterologous promoter.

The polynucleotides of the invention may comprise additional sequences, such as additional encoding sequences within the same transcription unit, controlling elements such as promoters, ribosome binding sites, 5'UTR, 3'UTR, transcription terminators, polyadenylation sites, additional transcription units under control of the same or a different promoter, sequences that permit cloning, expression, homologous recombination, and transformation of a host cell, and any such construct as may be desirable to provide embodiments of this invention.

Methods of Use and Article of Manufacture

The present invention includes the following method embodiments. In an embodiment, a method of vaccinating an animal comprising administering a composition comprising an *S. suis* strain and a pharmaceutical or veterinarily acceptable carrier, excipient, or vehicle to an animal is disclosed. In one aspect of this embodiment, the animal is a porcine.

In one embodiment of the invention, a prime-boost regimen can be employed, which is comprised of at least one primary administration and at least one booster administration using at least one common polypeptide, antigen, epitope or immunogen. Typically the immunological composition or vaccine used in primary administration is different in nature from those used as a booster. However, it is noted that the same composition can be used as the primary administration and the booster administration. This administration protocol is called "prime-boost".

A prime-boost regimen comprises at least one prime-administration and at least one boost administration using at least one common polypeptide and/or variants or fragments thereof. The vaccine used in prime-administration may be different in nature from those used as a later booster vaccine. The prime-administration may comprise one or more administrations. Similarly, the boost administration may comprise one or more administrations.

The dose volume of compositions for target species that are mammals, e.g., the dose volume of pig or swine compositions, based on bacterial antigens, is generally between about 0.1 to about 2.0 ml, between about 0.1 to about 1.0 ml, and between about 0.5 ml to about 1.0 ml.

The efficacy of the vaccines may be tested about 2 to 4 weeks after the last immunization by challenging animals, such as porcine, with a virulent strain of *S. suis*. Both homologous and heterologous strains are used for challenge to test the efficacy of the vaccine. The animal may be challenged by IM or SC injection, spray, intra-nasally, intra-ocularly, intra-tracheally, and/or orally. Samples from joints, lungs, brain, and/or mouth may be collected before and post-challenge and may be analyzed for the presence of *S. suis*-specific antibody.

The compositions comprising the bacterial strains of the invention used in the prime-boost protocols are contained in a pharmaceutically or veterinary acceptable vehicle, diluent or excipient. The protocols of the invention protect the animal from *S. suis* and/or prevent disease progression in an infected animal.

The various administrations are preferably carried out 1 to 6 weeks apart. Preferred time interval is 3 to 5 weeks, and optimally 4 weeks according to one embodiment, an annual booster is also envisioned. The animals, for example pigs, may be at least 3-4 weeks of age at the time of the first administration.

In another embodiment, the vaccine is administered to a a sow from about 3 weeks to about 6 weeks prefarrowing.

These sows should have reduced reproductive, nursery-age, and growing pig diseases as compared to unvaccinated sows.

It should be understood by one of skill in the art that the disclosure herein is provided by way of example and the present invention is not limited thereto. From the disclosure herein and the knowledge in the art, the skilled artisan can determine the number of administrations, the administration route, and the doses to be used for each injection protocol, without any undue experimentation. Instructions for standard laboratory procedures can be found in many texts and journal articles; see for example, Methods in Molecular Biology, Vol. 66 (Glenn E. Morris, Ed., 1996).

Another embodiment of the invention is a kit for performing a method of eliciting or inducing an immunological or protective response against S. suis in an animal comprising an S. suis immunological composition or vaccine and instructions for performing the method of delivery in an effective amount for eliciting an immune response in the animal.

Another embodiment of the invention is a kit for performing a method of inducing an immunological or protective response against S. suis in an animal comprising a composition or vaccine comprising an S. suis strain of the invention, and instructions for performing the method of delivery in an effective amount for eliciting an immune response in the animal.

Another embodiment of the invention is a kit for detecting the newly discovered strain of S. suis.

Yet another aspect of the present invention relates to a kit for prime-boost vaccination according to the present invention as described above. The kit may comprise at least two vials: a first vial containing a vaccine or composition for the prime-vaccination according to the present invention, and a second vial containing a vaccine or composition for the boost-vaccination according to the present invention. The kit may advantageously contain additional first or second vials for additional prime-vaccinations or additional boost-vaccinations.

The pharmaceutically or veterinarily acceptable carriers or vehicles or excipients are well known to the one skilled in the art. For example, a pharmaceutically or veterinarily acceptable carrier or vehicle or excipient can be a 0.9% NaCl (e.g., saline) solution or a phosphate buffer. Other pharmaceutically or veterinarily acceptable carrier or vehicle or excipients that can be used for methods of this invention include, but are not limited to, poly-(L-glutamate) or polyvinylpyrrolidone. The pharmaceutically or veterinarily acceptable carrier or vehicle or excipients may be any compound or combination of compounds facilitating the administration of the vector (or protein expressed from an inventive vector in vitro); advantageously, the carrier, vehicle or excipient may facilitate transfection and/or improve preservation of the vector (or protein). Doses and dose volumes are herein discussed in the general description and can also be determined by the skilled artisan from this disclosure read in conjunction with the knowledge in the art, without any undue experimentation.

The immunological compositions and vaccines according to the invention may comprise or consist essentially of one or more adjuvants. Suitable adjuvants for use in the practice of the present invention are (1) polymers of acrylic or methacrylic acid, maleic anhydride and alkenyl derivative polymers, (2) immunostimulating sequences (ISS), such as oligodeoxyribonucleotide sequences having one or more non-methylated CpG units (Klinman et al., 1996; WO98/16247), (3) an oil in water emulsion, such as the SPT emulsion described on page 147 of "Vaccine Design, The Subunit and Adjuvant Approach" published by M. Powell, M. Newman, Plenum Press 1995, and the emulsion MF59 described on page 183 of the same work, (4) cationic lipids containing a quaternary ammonium salt, e.g., DDA (5) cytokines, (6) aluminum hydroxide or aluminum phosphate, (7) saponin or (8) other adjuvants discussed in any document cited and incorporated by reference into the instant application, or (9) any combinations or mixtures thereof.

In an embodiment, adjuvants include those which promote improved absorption through mucosal linings. Some examples include MPL, LTK63, toxins, PLG microparticles and several others (Vajdy, M. Immunology and Cell Biology (2004) 82, 617-627). In an embodiment, the adjuvant may be a chitosan (Van der Lubben et al. 2001; Patel et al. 2005; Majithiya et al. 2008; U.S. Pat. No. 5,980,912).

In an embodiment, the adjuvant may be inactivated bacteria, an inactivated virus, fractions of inactivated bacteria, bacterial lipopolysaccharides, bacterial toxins, or derivatives or combinations thereof.

In an embodiment, the adjuvant comprises whole bacteria and/or viruses, including *H. parasuis, clostridium*, swine immunodeficiency virus (SIV), porcine circovirus (PCV), porcine reproductive and respiratory syndrome virus (PRRSV), *Mannhemia, Pasteurella, Histophious, Salmonella, Escherichia coli*, or combinations and/or variations thereof. In several embodiments, the adjuvant increases the animal's production of IgM, IgG, IgA, and/or combinations thereof.

REFERENCES

1. Hill J E, Gottschalk M, Brousseau R, Harel J, Hemmingsen S M, Goh S H. Biochemical analysis, cpn60 and 16S rDNA sequence data indicate that *Streptococcus suis* serotypes 32 and 34, isolated from pigs, are *Streptococcus orisratti*. Vet Microbiol. 2005; 107(1-2):63-9.
2. le Tien H T, Nishibori T, Nishitani Y, Nomoto R, Osawa R. Reappraisal of the taxonomy of *Streptococcus suis* serotypes 20,22,26, and 33 based on DNA-DNA homology and sodA and recN phylogenies. Vet Microbiol. 2013; 162(2-4):842-9.

The invention will now be further described by way of the following non-limiting examples.

EXAMPLES

Example 1—Analysis of a Reproductive Disease Outbreak

Figure 2A:
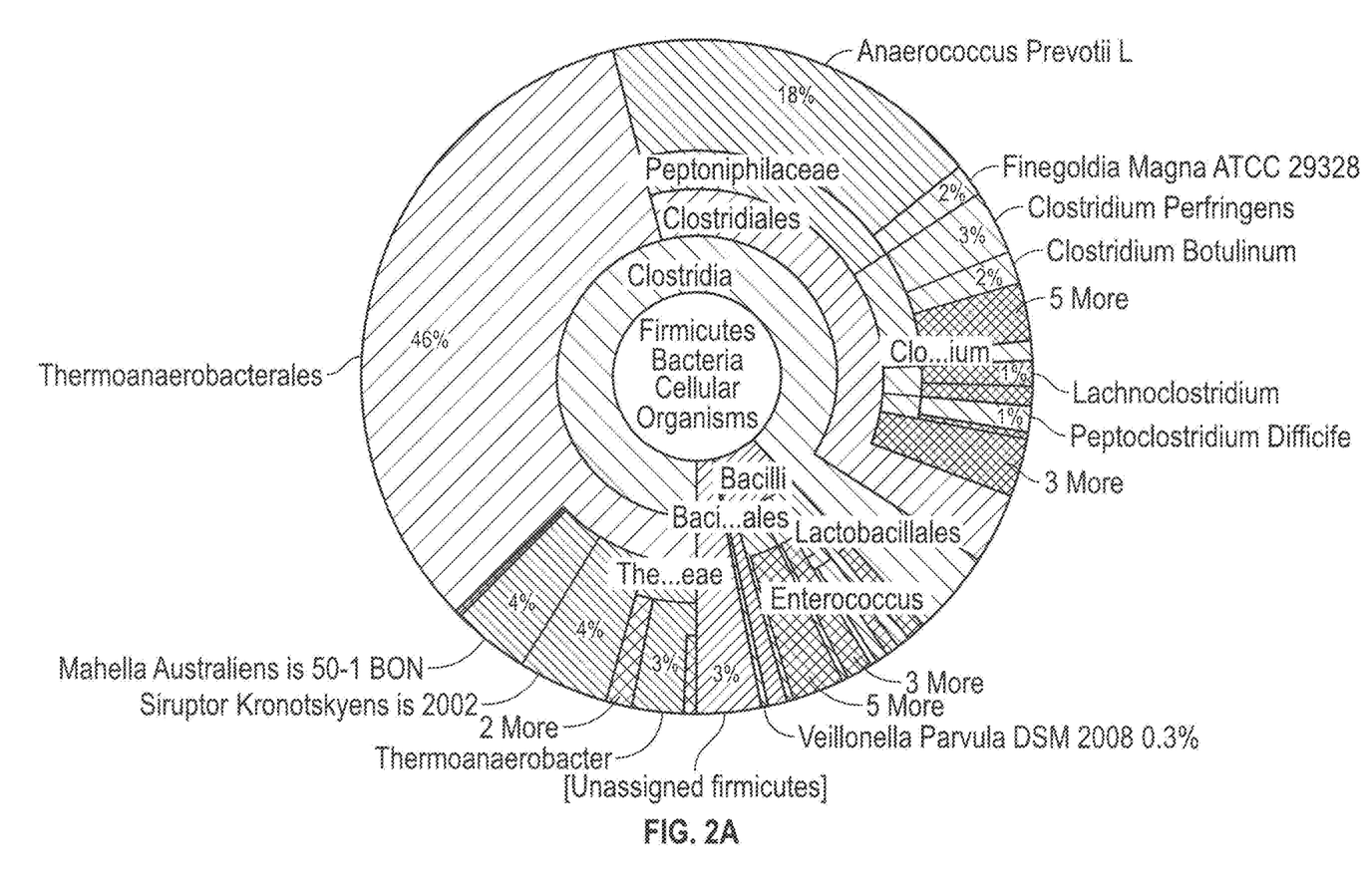
Figure 2B:
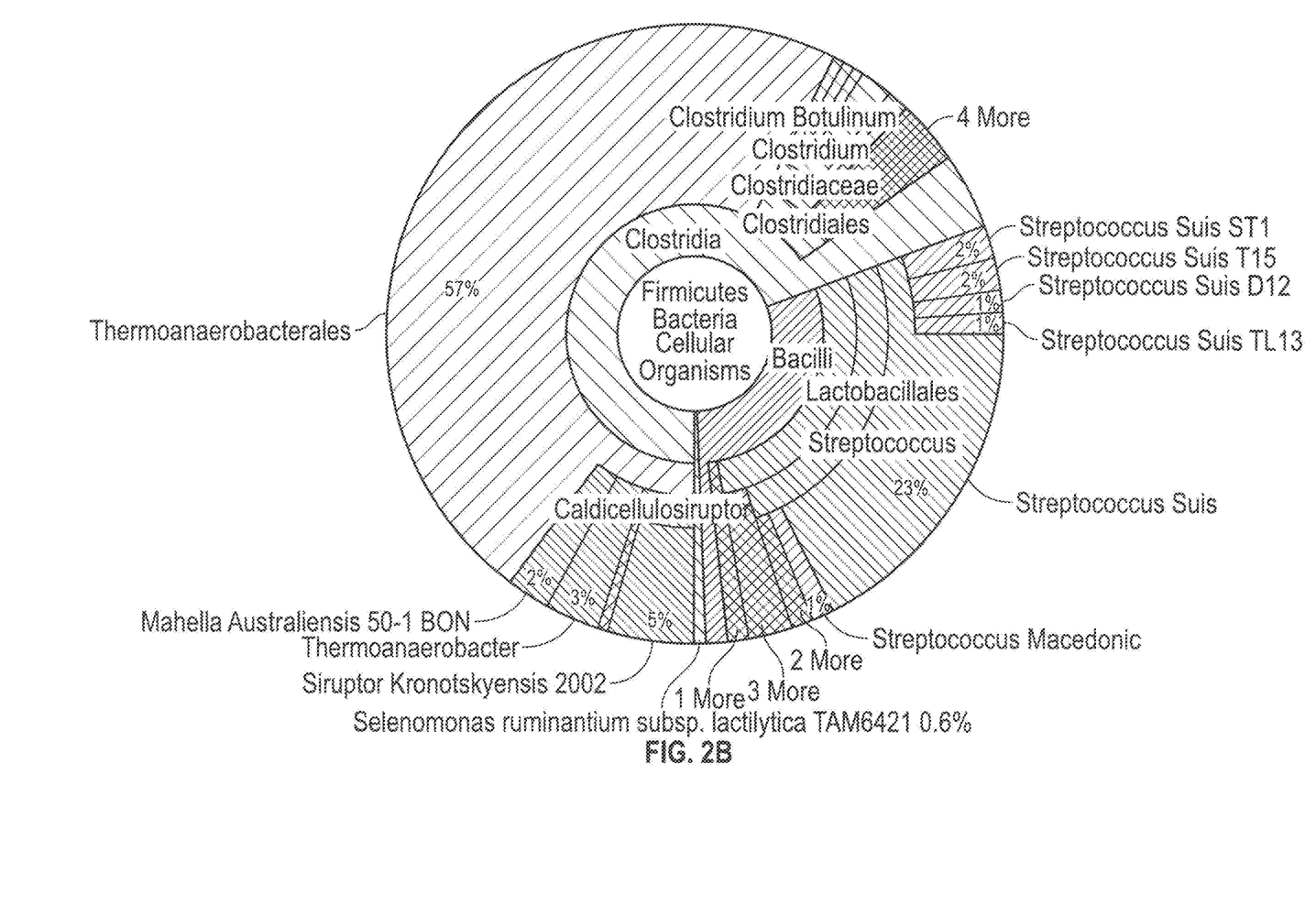

Vaginal swab samples were received as part of an investigation meant to identify the cause of a recent surge in abortions at a farm. Nasal swabs and tissue samples from the same herd were also received. FIG. 2a shows the normal distribution of bacteria in sows. FIG. 2b shows the bacterial distribution in aborting sows with vaginal discharge, noting that several strains of S. suis were isolated from the swab and tissue samples.

Figure 3:
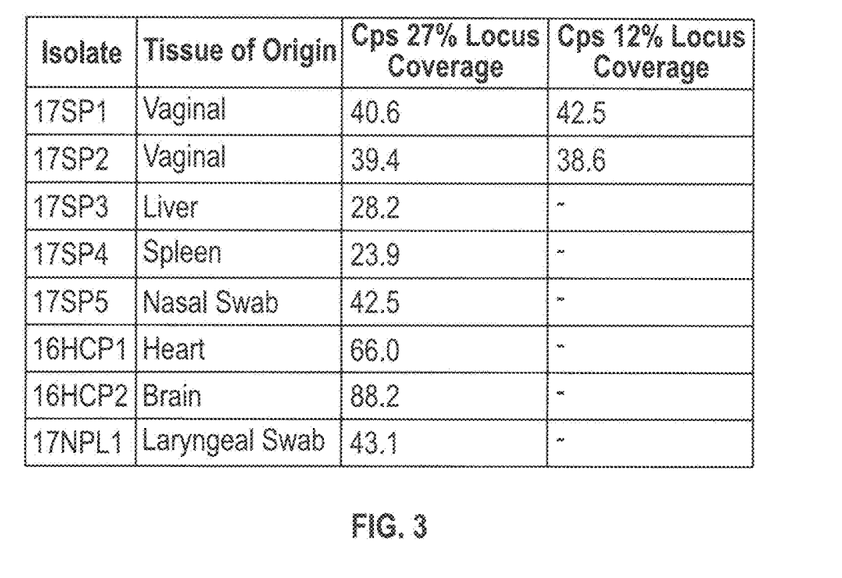
FIG. 3 shows map-based serotyping results from divergent serotype 27 strains used in comparative analysis.

Using a recently developed serotyping method (Lawrence P K: Map-based serotyping of *Streptococcus suis* field isolates for vaccine formulation. AAVLD annual meeting, 2015; aavld.org/assets/2017) many isolates were identified from these samples as highly divergent serotype strains with some similarity to serotypes 27 and 12 (FIG. 3). S. suis was the only pathogen detected that had any association with reproductive disease.

Standard typing methods were not able to definitively determine the cause of the reproductive disease outbreak. Therefore, to determine whether other abortifacient agents were present, a metagenomic analysis on the vaginal swabs and tissue samples was performed.

Example 2—Metagenomic Analysis of the Vaginal Swabs

Variant *S. suis* strains from this case were further analyzed using comparative genomics to identify virulence factors that were unique to the vaginal isolates. Draft genomes were assembled from the *S. suis* strains that had similar serotypes from this case as well as two other strains in the collection that displayed similar serotyping results against serotype 27.

Vaginal swab samples were taken from symptomatic and asymptomatic sows on the same farm and placed in a nucleic acid preservation solution prior to shipping. RNA was extracted from all samples, converted to cDNA, and used for library preparation. Sequencing was performed using a MiSeq instrument using 2×300 bp chemistry. Metagenomic analysis was performed using Kraken after filtering host reads against the *Sus scrofa* genome. Results were visualized using Krona. Each of these steps was carried out according to standard methods known in the art and described in the references. See, for example, Aline, Ines, et al. "Differential Sharing and Distinct Co-Occurrence Networks among Spatially Close Bacterial Microbiota of Bark, Mosses and Lichens-*AGRIS: International Information System for the Agricultural Science and Technology*, Hillsdale, N.J.: B. L. Erlbaum Associated, 1982, 1 Jan. 1970, agris.fao.org/agris-search/search.do?recordID=US201700210871.

Figure 4:
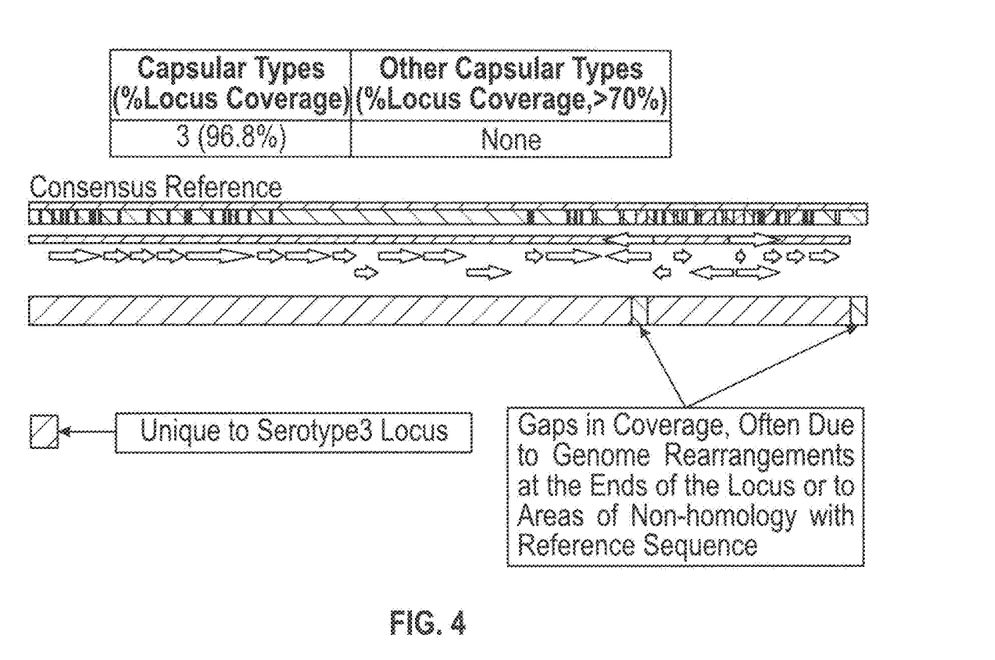
FIG. 4 shows how a simple serotype 3 locus can be inferred based on whole genome sequencing. The solid blue line shows regions unique and similar to serotype 3.
Figure 6:
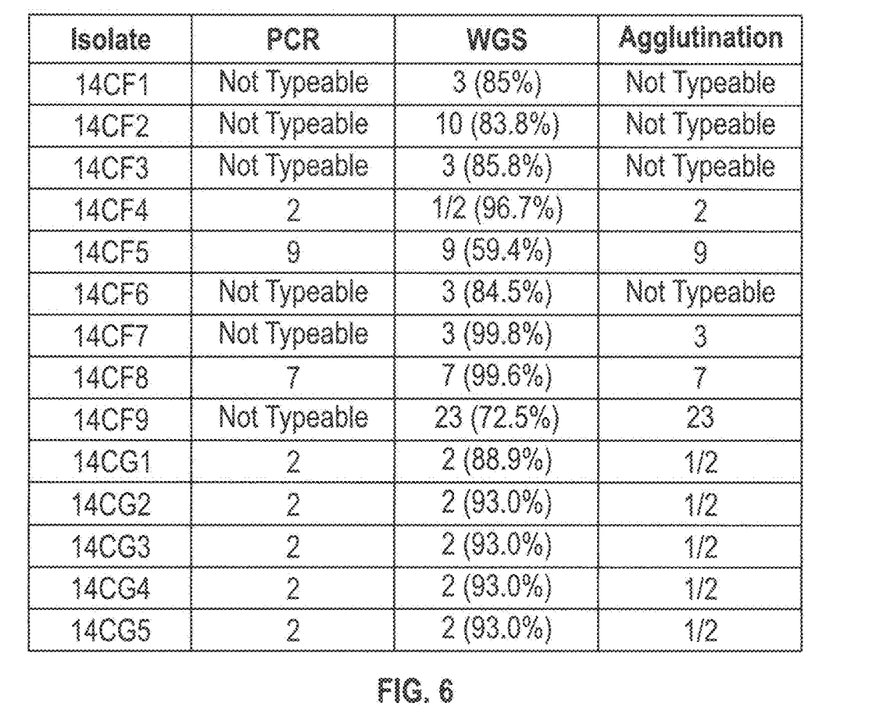
FIG. 6 shows discrepancy between conventional serotyping techniques (PCR, agglutination) versus whole genome sequencing of field isolates.
Figure 7:
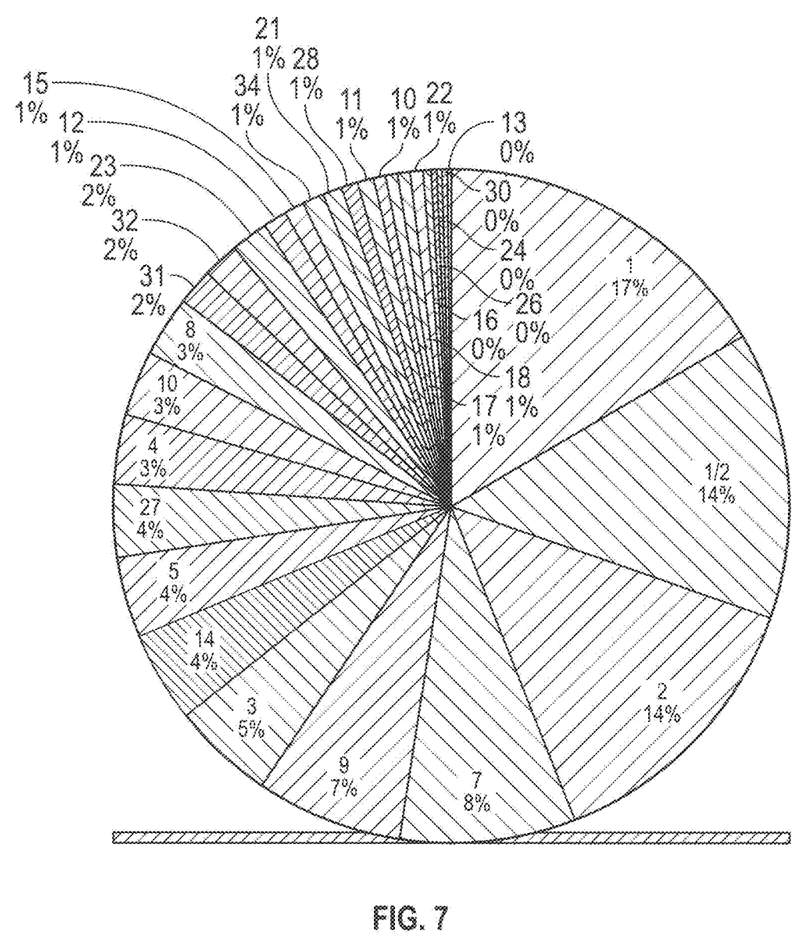
FIG. 7 shows distribution of *Streptococcus suis* serotypes from field samples across the USA (using NPL database).

Following identification of *S. suis* as a potential abortifacient agent, isolates were obtained from different pigs on the same farm site and subjected to serotyping using a previously described method (Lawrence P K, 2015). Genomes were sequenced on a MiSeq instrument using 2×150 bp chemistry and were de novo assembled. Genome comparisons were made amongst all isolates that shared a serotype 27 genotype. These comparisons are shown in FIG. 4, and also in FIGS. 1 and 6.

Figure 1:
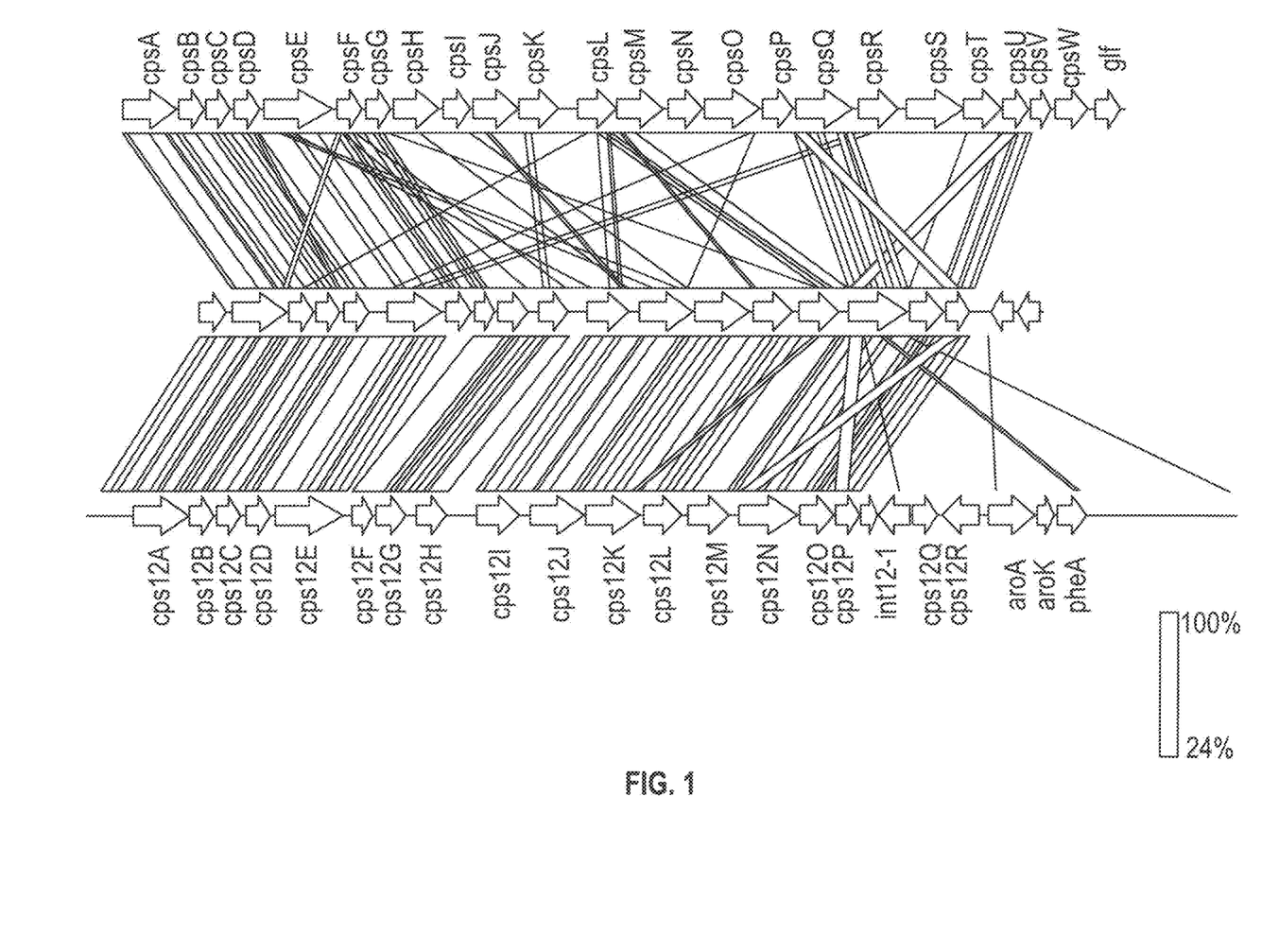
FIG. 1 shows a capsular operon comparison between vaginal swab isolates and Cps operons from YS-149 (novel Cps locus strain) and a Serotype 12 reference strain.

The results obtained from the metagenome samples were surprising; parasitologists would not expect to identify *S. suis* as a possible abortifacient agent in this case. However, there was little else present in the metagenome that could explain the sequelae reported by the veterinarians at this farm site. The comparative analysis initially focused on comparing strains whose closest serotype match was to serotype 27 because a strain with homology to both serotypes 27 and 12 had not been previously isolated. However, the overall structure of the capsular locus in the vaginal isolates was closer to serotype 12. In particular, the cpsN, cpsO, and cpsP genes at the 3' end of the locus are shared between the vaginal isolates and serotypes 12 and 20 (FIG. 1).

Figure 5:
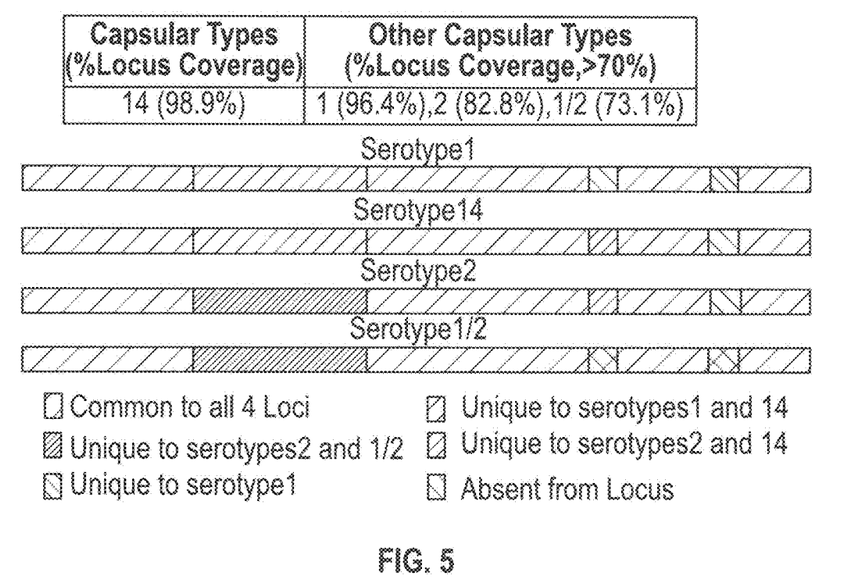
FIG. 5 shows how a complex mosaic capsule structure and CPS loci is inferred based on whole genome sequencing. The capsule region is shared between serotypes 1, 2, ½ and 14. Inferring the correct capsule aids in cross protection.

However, while the cpsN gene from the vaginal isolates bore significant similarity to serotype 12 at the nucleotide level, the cpsO and cpsP genes bore greater similarity to the cpsT and cpsU gens from a previously reported isolate bearing a novel capsule, YS-149 (FIG. 1) (Zheng H, et al.: Eight novel capsular polysaccharide synthesis gene loci identified in nontypeable *Streptococcus suis* isolates. Appl. Environ. Microbiol., 2015, 81:4111-4119). Interestingly, the capsular loci of the vaginal isolates also bears a Fic family protein which they share with YS-149 (cpsF) and serotypes 3, 13, 17, 18, 19, 21, 24, 29, 33 (Okura M, et al.: Genetic analysis of capsular polysaccharide synthesis gene clusters from all serotypes of *Streptococcus suis*: potential mechanisms for generation of capsular variation. Appl Environ Microbial. 2013, 79:2796-2806) but not with serotype 12. Furthermore, the glycosyl transferase and epimerase genes annotated as cpsF and cpsG in serotype 12 are more closely related to serotypes 24 and 21 in the vaginal isolates than to any other serotype (FIG. 5).

Such mosaic structure does not appear to be uncommon amongst *S. suis* isolates since additional strains with novel capsular loci have been reported recently (Pan Z, et al.: Novel variant serotype of *Streptococcus suis* isolated from piglets with meningitis. Appl. Environ. Microbiol., 2015, 81:976-985; Qiu Z, et al.: Novel capsular polysaccharide loci and new diagnostic tools for high-throughput capsular gene typing in *Streptococcus suis*. Appl. Environ. Microbiol., 2016, 21:7102-7112). However, this is the first report in which a particular serotype has been tentatively associated with reproductive disease.

The presence of the alternative secretory pathway in the genome of the vaginal isolates was also an unusual finding. The unique constellation of genes consisting of the novel capsular locus, the alternative secretory pathway, and the cbpD gene may confer upon these strains a unique ability to colonize the vaginal tract. Not only do these genes encode several unique adhesins, but together, they may confer a competitive advantage upon these isolates. Secretion of CbpD in *S. pneumoniae* has been associated with lysis of cells from closely related species (Edholm V, et al.: Fratricide in *Streptococcus pneumoniae*: contributions and role of the cell wall hydrolases CbpD, LytA and LytC. Microbiology., 2009, 155:2223-2234). In *S. pneumoniae*, lytA and lytC were required for efficient target cell lysis in vitro. However, when divalent cations were sequestered using EDTA, lysis was dramatically enhanced using CbpD alone. One might expect that similar conditions would be common in the reproductive tract of infected sows. If CbpD can be exported through the alternative secretory pathway identified herein, then the vaginal isolates might gain an important advantage that could allow them to outcompete other strains present in the reproductive tract.

Thus, the strains appeared to have "alternative forms of genes", which are defined herein as "alleles", relative to their parent *S. suis* strain. In an embodiment, the alternative alleles are responsible for reduced virulence.

Additionally it is believed that two operons contribute to the pathology associated with these strains by serving as host-cell adhesins. The first is an alternative secretory operon. The function of the secretory operon is to export serine-rich repeat glycoproteins to the cell surface where they have been shown to serve as host-cell adhesins. The second operon is a set of capsular genes that are involved in phosphorylcholine metabolism. The capsular genes contributes to the incorporation of phosyphorylcholine into the cell wall, altering capsular structure and allowing for the attachment of choline binding proteins. Choline binding proteins secreted by pathogenic and commensal strains of *Streptococcus* sp. have been implicated as host cell adhesins.

Additionally, the newly identified strains were found to possess a lytic choline binding protein D homolog (cbpD). This protein functions differently in strain with a competent export system.

These findings are shown in the following SEQ ID NOS:
SEQ ID NOS:1 and 2: 1307.1544.peg.724 Beta-1,3-glucosyltransferase [*Streptococcus suis* 17-00802-29] [aSec operon genes] and its translation.

SEQ ID NOS:3 and 4: 1307.1544.peg.723 Nucleotide sugar synthetase-like protein [*Streptococcus suis* 17-00802-29] [aSec operon genes] and its translation.

SEQ ID NOS:5 and 6: 1307.1544.peg.722 Glycosyl transferase, family 8 [*Streptococcus suis* 17-00802-29] [aSec operon genes] and its translation.

SEQ ID NOS:7 and 8: 1307.1544.peg.721 Beta-1,3-glucosyltransferase [*Streptococcus suis* 17-00802-29] [aSec operon genes] and its translation.

SEQ ID NOS:9 and 10: 1307.1544.peg.720 Predicted cell-wall-anchored protein SasA (LPXTG motif) [*Streptococcus suis* 17-00802-29] [aSec operon genes] and its translation.

SEQ ID NO:11 and 12: 11 1307.1544.peg.719 Preprotein translocase SecY2 subunit (TC 3.A.5.1.1) [*Streptococcus suis* 17-00802-29] [aSec operon genes] and its translation.

SEQ ID NOS:13 and 14: 1307.1544.peg.718 Accessory secretory protein Asp1 [*Streptococcus suis* 17-00802-29] [aSec operon genes] and its translation.

SEQ ID NOS:15 and 16: 1307.1544.peg.717 Accessory secretory protein Asp2 [*Streptococcus suis* 17-00802-29] [aSec operon genes] and its translation.

SEQ ID NOS:17 and 18: 1307.1544.peg.716 Accessory secretory protein Asp3 [*Streptococcus suis* 17-00802-29] [aSec operon genes] and its translation.

SEQ ID NOS:19 and 20: 1307.1544.peg.715 Protein export cytoplasm protein SecA2 ATPase RNA helicase (TC 3.A.5.1.1) [*Streptococcus suis* 17-00802-29] [aSec operon genes] and its translation.

SEQ ID NOS:21 and 22: 1307.1544.peg.714 Poly(glycerol-phosphate) alpha-glucosyltransferase GftA (EC 2.4.1.52) [*Streptococcus suis* 17-00802-29] [aSec operon genes] and its translation.

SEQ ID NOS:23 and 24: 1307.1544.peg.713 GftB: Glycosyl transferase, family 8 [*Streptococcus suis* 17-00802-29] [aSec operon genes] and its translation.

SEQ ID NOS:25 and 26: 1307.1544.peg.1161 Choline-phosphate cytidylyltransferase LicC (EC 2.7.7.15)/Choline kinase (EC 2.7.1.32) [*Streptococcus suis* 17-00802-29] [licABC genes] and its translation.

SEQ ID NOS:27 and 28: 1307.1544.peg.1160 Choline permease LicB [*Streptococcus suis* 17-00802-29] [licABC genes] and its translation.

SEQ ID NOS:29 and 30: 1307.1544.peg.1159 Choline-phosphate cytidylyltransferase (EC 2.7.7.15) LicA [*Streptococcus suis* 17-00802-29] [licABC genes] and its translation.

SEQ ID NOS:31 and 32: 17-00802-29_Vaginal_CbpD_real *Streptococcus suis* 17-00802-29 and its translation.

The invention therefore includes methods for preparing and/or formulating immunogenic compositions; e.g., culturing or growing or propagating the bacteria on or in suitable medium, harvesting the bacteria, optionally killing, inactivating or attenuating the bacteria, and optionally admixing the bacteria with a suitable veterinarily or pharmaceutically acceptable carrier, excipient, diluent or vehicle and/or an adjuvant and/or stabilizer. Thus, the invention also relates to the use of the bacteria in formulating such compositions.

Summary: The analysis identified two operons that might contribute to the pathology associated with these strains. The first was an alternative secretory operon and the second was a set of capsular genes that are involved in phosphorylcholine metabolism. The function of the secretory operon is to export serine-rich repeat glycoproteins to the cell surface where they have been shown to serve as host-cell adhesins (Bensing B A, Seepersaud R, Yen Y T, Sullam P M: Selective transport by SecA2: an expanding family of customized motor proteins. Biochim Biophys Acta. 2014, 1843:1674-1686). The capsular genes might contribute to the incorporation of phosyphorylcholine into the cell wall, altering capsular structure and allowing for the attachment of choline binding proteins. Choline binding proteins secreted by pathogenic and commensal strains of *Streptococcus* sp. have been implicated as host cell adhesins (Hakenbeck R, Msfhout A, Denapaite D, Bruckner R: Versatility of choline metabolism and choline-binding proteins in *Streptococcus pneumoniae* and commensal streptococci. FEMS Microbiol Rev., 2009 33:572-586). All of the isolates sequenced possess a lytic choline binding protein D homolog (cbpD) but this protein may function differently in a strain with a potentially competent export system such as the isolated vaginal strains.

FIG. 4 shows how a serotype 3 locus can be inferred based on whole genome sequencing. The solid blue line shows regions unique and similar to serotype 3. Serotype 3 is an example of a simple locus.

Example 3—Development of a New Method of Cellular Typing of *S. suis* that Accurately Identifies all Strains Based on the successful identification described in Example 2, the new method of serotyping is described herein.

The following work flow describes capsule typing based on whole genome sequence (WGS) by way of sequencing and serotyping of isolates. The genomic DNA is extracted and sequenced and the capsule type is derived from the draft genome.

Isolating samples from an infected animal;
extracting genomic DNA;
Purifying genomic DNA;
Preparing libraries for sequencing the genomic DNA;
Sequencing the genomic DNA;
de novo assembling a draft genome; and
Deriving the capsule type from the draft genome by mapping selected gene references to a genomic database.

In this example, the genomic database was derived from the National Center for Biotechnology Information (NCBI, blast.ncbi.nlm.nih.gov/Blast.cgi) and NCBI's GenBank (ncbi.nlm.nih.gov/genbank), and includes additional samples isolated. Additional samples can be found in many public databases, such as the Superfund: National Priorities List (NPL, epa.gov/superfund/superfund-national-priorities-list-npl).

The serotypes identified and used in this example are presented in the following SEQ ID NOS: SEQ ID NO:33 is serotype 1/2 and SEQ ID NOS:34-67 are serotypes 1-34, respectively.

Vaccines and immunogenic agents derived in this manner will provide improved protection against *S. suis* infection compared to other vaccine formulation methods.

Example 4—Vaccine Against the New Strain of *S. suis*

A *Streptococcus* vaccine directed to the new strain of *S. suis* causing disease in reproductive, nursery-age, and growing pigs can be prepared using a polynucleotide selected from the group of SEQ ID NOS: 3, 7, or 11, or a combination thereof, or from a polypeptide that encodes a polypeptide from the sequences selected from the group of SEQ ID NOS: 4, 8, or 12, or a combination thereof.

The vaccine composition may further include a pharmaceutically or veterinary acceptable vehicle, diluent or excipient. It may also include an adjuvant, wherein the adjuvant may be inactivated bacteria, inactivated virus, fractions of inactivated bacteria, bacterial lipopolysaccharides, bacterial toxins, or derivatives or combinations thereof.

Processes and protocols for developing a vaccine are found in patents and publications related to vaccine development, and scholarly articles relating to vaccine development, such as those that can be found in the journal *Vaccines*, journals.elsevier.com/vaccine.

Example 5—Kits for Protecting Against the New Strain of *S. suis*

The invention also includes kits for detecting strains of *S. suis* comprising materials and reagents for collecting samples and materials and reagents for performing a metagenomics analysis.

The invention includes a kit for eliciting or inducing an immunological or protective response against *S. suis* in an animal that doesn't necessarily use a vaccine formulation. For example, simpler methods of exposing animals to an *S. suis* immunological composition may be used, such as methods for aerosol delivery. An amount needed to elicit an immune response can be blown into a nostril. The dosing amount would depend on the age and size of the animal.

The invention also includes kits for prime-boost vaccination comprising at least two vials: a vial containing a vaccine or composition for the prime-vaccination according to the present invention, and a second vial containing a vaccine or composition for the boost-vaccination according to the present invention.

This kit can also include additional vials for additional prime-vaccinations or additional boost-vaccinations.

In conclusion, this study has revealed the presence of a strain of *S. suis* that possesses novel virulence factors and capsular structure in sows exhibiting symptoms of reproductive disease.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

---

SEQUENCE LISTING (67 sequences)

SEQ ID NO: 1 - DNA, 879 bp, Streptococcus suis
  CDS (1)..(879)
atggaaaaagtcagtgtgattgtacctgtttacaatggagaaaaacatcttagacagtgtgtcgagtctattatggctcaggaatatgaaaatttagagatactgttaattaatgatggctccaaggatggctcagctctcctttgtgagcaattaaagcatcaagattcacgggtaaaagttattcataaacgacagaatgaaggtcttggtgcagcaagaaatacctcacttgatgtagctacaggagaatatatcgtttttgtagatgcagatgattggatagatcccaaccatgtaagtgatctatacgatttgatgaaacggacaggcagtgacgtagctatttcaaactttacccaatataatgaagatacagggcactataacatacatattcttcctgaggactactatgaagcggtatacactcctgaagaatggtttaactatcaatatggagtagggcataatattagcctatgcttcacggttccttggtctaagatgtataaaaagtccttatttgaatacatactctatcccacagatggctttggagaagatgatcgaacgacttggaaaacatatttagctgctgataagattgcctatatgcaccgttctagtttgatttatcgtatcaacgaagggtccatgacgcaaacagcagaccaggctactattttttcaacggttccagtggcggagcgattagaagtattggggttgcttggttttgatttgtcaaaggaaattgcggcttttaaatggcgttcgcagatcaatcgtgacagcaaactacgtcagggggatgtagtagcttataagaatttggaattccgcaaacgaatgatagaaaagtacggtaaaaactaa

SEQ ID NO: 2 - protein, 292 aa, Streptococcus suis
MEKVSVIVPVYNGEKHLRQCVESIMAQEYENLEILLINDGSKDGSALLCEQLKHQDSRVKVIHKRQNEGLGAARNTSLDVATGEYIVFVDADDWIDPNHVSDLYDLMKRTGSDVAISNFTQYNEDTGHYNIHILPEDYYEAVYTPEEWFNYQYGVGHNISLCFTVPWSKMYKKSLFEYILYPTDGFGEDDRTTWKTYLAADKIAYMHRSSLIYRINEGSMTQTADQATIFSTVPVAERLEVLGLLGFDLSKEIAAFKWRSQINRDSKLRQGDVVAYKNLEFRKRMIEKYGKN

SEQ ID NO: 3 - DNA, 927 bp, Streptococcus suis
  CDS (1)..(927)
atggtgacggatgttgcgactacacttggatatcgggaattggctattcatgcctatcgcatggatgctgatacaccggaggaactcagcaaacgtctggatggtgtcattgcggggttgagacatggagatgtggtaatttttcagacgccaacctggaatacgacagcatttgatgaaaaacttatggccaaattgcgtgcctaccaaataaaaatcgttatttttattcacgatgtcgttcccctaatgtttgcaggaaactactacttgatggaccgtacaattgcctattataatcaggcagatgtgattgtggcaccgagtcaacaaatgattgataatttaaaacgtcatggtctaactgtagaaaaaacgattgtacagggaatgtgggatcatccaactaatgttccgcagttaccagcaattttcaaaaaagaaatccattttccagggtctccagatcgatttagttttgtgaaatcttgggagtacgacgttcaattgaacttgtatgcacgtcaggaagcagagttgcctacaaatgtgaagcattttacctatcgaccagatgagcaattgctgattgaaatgtcagaaggtggatttgggctggtttggatggatgatcacgataaagagtatcaaaaactatactgtccttataaattaggtgcgtttgttgccgcagggattcctgttattgttcagcgtggtttagccaatcaagaaattgtagaaaaaaatggcttgggtatggttgtagatagtctagaggaagctgttgctcgaatcgagaccatgtctgtcgaagaataccaaggaatggtagctaaggtccgctcatttagttctttggttcgacaaggcttctttacaagaaaattgttgacggaagctgtctttgaagcggtatgtaagtag

SEQ ID NO: 4 - protein, 308 aa, Streptococcus suis
MVTDVATTLGYRELAIHAYRMDADTPEELSKRLDGVIAGLRHGDVVIFQTPTWNTTAFDEKLMAKLRAYQIKIVIFIHDVVPLMFAGNYYLMDRTIAYYNQADVIVAPSQQMIDNLKRHGLTVEKTIVQGMWDHPTNVPQLPAIFKKEIHFPGSPDRFSFVKSWEYDVQLNLYARQEAELPTNVKHFTYRPDEQLLIEMSEGGFGLVWMDDHDKEYQKLYCPYKLGAFVAAGIPVIVQRGLANQEIVEKNGLGMVVDSLEEAVARIETMSVEEYQGMVAKVRSFSSLVRQGFFTRKLLTEAVFEAVCK

SEQ ID NO: 5 - DNA, 1746 bp, Streptococcus suis
  CDS (1)..(1746)
atgaaaaaattagaagatattcgggtgttacccattttagaaagccttgaatttattcaagaaaataatgcttcagttgtccggttcggtgatggtgaaatcgatctgattctagggcatagcattccttatcaggcttatgataaagaactggctggagcattgaaaacaattttacagatgcctagtaatgaacagctgttggtgtgcctgccagatgtttttcagaatcttgagcgctacaatagcaatgctcgttatttctggagcaagcattttgaacagtaccatgctttttacgaagaagaatgccaatcagagtggtatggttcgacgttcctgtctcggccatatattgatttggttgacaagagccaatcagaacactattttgctgccatcaaaggactttgggaaaatagagacatattaattgttgaaggggaaacttcacgctctgggatggggaacgacttatttgatggagcaacttctgtttcgagaataatttgtccgtccaaaaatgcctattcatcttatgaccaaattctctctgcgattctagttcatgctgagaacagattggttatcttgatgttgggaccaacagcaaaagtactttcatatgatttgacgatgcgaggttatcaggcgattgatctaggccatattgactcagagtatgaatggtttaaaatgaaggctacaacaaaggtcaaattgggacataaacacactgcagaatttaattatgatgaaaatattgatgaggaagttgatgcaacttacctaaatcaagtattagaatgggtttctgtcccagcaaaagcgcaaaaatccaaagaggagaaagaaatgaagcccgacttgataagtgtgattgttcctgtctacaatgtcaaaccctatctgacccgctgcttagactcactgttgaagcaaacccatactaattttgaattgttattggttaatgatggttcctcagatggttcggcatttgttttggaagactatgccaagaaggatcagcgcattcgcattattcatcaggaaaatagcggtgtttccgctgctcgtaatcgcgctatagatgaggcgcggggggaatatattacatttattgattcagatgattttgtagaagatttttacttggagcatctatataaggcagcagtttcgacagggtcagatattgctgctaccaatttttcttcatttaatgaagagagacagagttttttattttatcatactaaggaatcctattttcaaaaggtatatacggtacaagaatggatggatttagaaggagatatgaaaaacaatatgcaccttgcctttacattctcgcctttgaagttgtttaaacgggaactttttggagatatacgttatcctgttggtcgtcttcgcgaggatgatgcgacaatgtataagttgtatctaaaagccaaccaaatacactttactaatgaaggtccgtattactactcacaacgagctgaagggctttcacgaacggtaatgctcaatgatattgcaaccatgatatcaaatgccgaagagagaatttctttaatggtggcgcttggctacaatccggctgctcaagtgaagtcatatgtcgaacgcttaaaaaaatgtcgtggtgacgccctatatgccggccaaatcaatctttactggacaatctgtgcaaaaattgatttgtttgaaaactatcagaaaagggaaaactaa

SEQ ID NO: 6 - protein, 581 aa, Streptococcus suis
MKKLEDIRVLPILESLEFIQENNASVVRFGDGEIDLILGHSIPYQAYDKELAGALKTILQMPSNEQLLVCLPDVFQNLERYNSNARYFWSKHFEQYHAFYEEECQSEWYGSTFLSRPYIDLVDKSQSEHYFAAIKGLWENRDILIVEGETSRSGMGNDLFDGATSVSRIICPSKNAYSSYDQILSAILVHAENRLVILMLGPTAKVLSYDLTMRGYQAIDLGHIDSEYEWFKMKATTKVKLGHKHTAEFNYDENIDEEVDATYLNQVLEWVSVPAKAQKSKEEKEMKPDLISVIVPVYNVKPYLTRCLDSLLKQTHTNFELLLVNDGSSDGSAFVLEDYAKKDQRIRIIHQENSGVSAARNRAIDEARGEYITFIDSDDFVEDFYLEHLYKAAVSTGSDIAATNFSSFNEERQSFLFYHTKESYFQKVYTVQEWMDLEGDMKNNMHLAFTFSPLKLFKRELFGDIRYPVGRLREDDATMYKLYLKANQIHFTNEGPYYYSQRAEGLSRTVMLNDIATMISNAEERISLMVALGYNPAAQVKSYVERLKKCRGDALYAGQINLYWTICAKIDLFENYQKREN

SEQ ID NO: 7 - DNA, 708 bp, Streptococcus suis
  CDS (1)..(708)
ttgataaataaaagtcttggtggtggagtaggagctgctcggaattcagcccttccactcattacaggagaatttgttctttttgtagataatgatgactggttggaaccaaaccatatcgaagttctttacaaagctttgaaagagacagattcagatatttctattgttaattttacccagtttatagaagagagagggagttttgcttttcatgtaacagaaaaggactattttcgagaggtttatactcctcaagaatggtttgctagagaatatgatgggcgattttcctttagtcagtgttttacagttccgtggtgtaaattatataaggcgtctttgtttgagaatattagctatcctgaagacgaaaaagttgaggatgactatacgacctggaagctatatttgatggctgatcggattgtatttaccaatactgcgttgtattatcatcgtaagcgtgagactagtgtgactaaaacagtagagacaacttatgtttttccgttaaaaagtatcgaagagcgaataactattttgagtctgattggttttaatatagccgcagagttgagagcttatcggtggagattagatcttcatagggatagttttttggcgtcaggtcatatgcaagaatatcaaaaatgtctgcaaaaaatagctattttggataagcattataataaaaataatatatag

SEQ ID NO: 8 - protein, 235 aa, Streptococcus suis
LINKSLGGGVGAARNSALPLITGEFVLFVDNDDWLEPNHIEVLYKALKETDSDISIVNFTQFIEERGSFAFHVTEKDYFREVYTPQEWFAREYDGRFSFSQCFTVPWCKLYKASLFENISYPEDEKVEDDYTTWKLYLMADRIVFTNTALYYHRKRETSVTKTVETTYVFPLKSIEERITILSLIGFNIAAELRAYRWRLDLHRDSFLASGHMQEYQKCLQKIAILDKHYNKNNI

SEQ ID NO: 9 - DNA, 6192 bp, Streptococcus suis
  CDS (1)..(6192)
atggaaagaaaaaacggaaagcggtataccgaggtctcgcgtaaaagccgagtgaaaatgcacaagtctgggaagcattgggtacgtacagttatgtcacagcttgggcttattcaattggggaaacgtagcgcttctgaaagtccaaaaataaaattaacttctgcaagccagcaagagtcagctgcgaagatgttgcgtggattggtagctgcaagtgctgtggtcggtggaggacttactgcagagcaagttcttgccgaagatacggtaattgctactgaagtaaccacatcagtgctagctaacgaagacactattcgtatgagtgatgctggtacggaatcggatacatcttcacaatcagtaagtgaatccgagtcgacaagtcattcagagtcaatcagtgactctgaatctattagtagttcggaatctgatagcgtatcagcttcgacaagtgagtcagtatcagaaagtgagtcagtatcagaaagtgaatcagtatcagaaagtgaatcgatttcatttagtgaatcgatttcatttagtgaatctacttcttcaagtgagtcgacaattgcttcagaaaatagtcagtcttcatcaacgacatcagagttatcagagagctcaactacagactcgacaacttcagaagaaactcctcaacaagtcttagagcaagtagtatcggaagctgaaattcttattcagattgccgagtcgaaactagaggctgctccagatagtgatttagcagttgctgtggctgtttcacgaacaaatttagaaacagcgaaacaattgttgggaaattcgaacgctactataacagatatccagacaattacttctgcccttcaaaatagttctcaattattggggttagagttgctgaaaaacgaagaagatggcatgattacgtttgctcttgacacagcaacgacagcaaccgtgaccaaagttggcgaaggatatggtattttggttgatacactttcaactgcaacgccagcaatgacagatgctaatggggcagccatttctaatccgacgaataatacaagctttacaccttcatcagattctgaacgctacacatttaactattcgaaatttaactggtttggtgatcagctgacggatcaaactatcaaagataactactatttccgttattctttagattatgatacaacaacaacgacaacttatgtcgagttagttaataagactaataatacagttgttgaaagccatactttagaaaaaggtcaaacagcaacttttacttatttccaaaactactcaggtgctaataaccggcctctaactattacttacggtgacagtacctcatcaagcacaacggcaggagaactccaactacagtataacggtggaacgctcactaataccttggttccaacctatcaagaatacacaacatactataagacaactgatggtaaaacaatagcaacctatactattaaaggtattggtggtcaaatggctacgccatctgccaaacgtgattttgtaggctatgactatgcaagtacaaccggtggtactccggtacgcctttattctccaggaacgatttataatgatggtgcgatttcaacatcgtatattaaacgtctggcagaggtagtagatgagaagggtagtcttgttaagactgtttgggtaaaagatccgacttacactggaaccgttgattacaactcaacagacacgacaggctttatcaaagtcatggaaacgtctgttatggctcctggaacagcgaatacaagtcttgttgttcctgtgacagatgttatctcagctgaagaatctgctttggctaccgcaaatgctcaagctggtaaaactggtaatgatatcttctctgtcatctatgaagataactaccagttaattcgtatcggttttgatggatatgctaaagcggcgaaaagctatcctgtaagtatgttagtgcaagttattctgaaatcaagtcacccggattatgcaccaaactatacagattcagcaggtaaggtaataaacccaaataccaaaggatcatcggtaagattagagaacggtttgaattcaactacagttaacgaaacaacacactggtacacagttgacaaacctgagtctgagtcgctttctaactcaaactcaaattccttgtctgaatctgagtcaaactcaacgtctgtatcagaatcgatttcggaatctgttagagaatctgtatccgagtctatttcagaatcagtatttgaatcagtctctgagtcaattagtgaatccgtatcagagtctgtatctgaatcagtatcagaatcaatctcagaatcagtcagcgagtcagtttctgaatccatttccgaatcagtatcagagtcaatcagcgaatccgtctctgagtcagtatcagaatcaatctctgagtcagtatcagaatccatttccgaatcagtatcggagtcagtatcagaatcaatctcagaatctgtgtctgaatcagtctctgagtcaattagtgaatccgtatcagagtcagtatcagagtcagtatcagagtcagtatcagaatcaatctcagaatctgtgtctgaatcagtatcggagtcaatcagcgaatccgtatcagagtcagtttcagaatccatttctgagtcagtatcagaatcagtatcagaatcaatcagtgaatccgtctctgagtctgtatctgaatcaatttcagaatccgtgtctgaatcagtatcagagtcaatcagcgaatccgtctctgagtcagtatcagaatcaatttccgaatcagtatcagaatcagtatcagaatcaatcagcgaatccgtctctgagtcagtatcagaatctatctcagaatccatttctgagtcagtatcagaatcagtatcagaatcaatttctgagtcagtatcagaatcaatctcagaatctgtgtctgaatcagtatcagagtcaatcagcgaatccgtatcagagtcagtatcagaatcaatctcagaatccatttctgagtccgtatctgaatcagtatcagaatcaatcagcgaatccgtctctgagtcagtatctgaatcaatttcagaatccgtgtctgaatccgtatcagagtcagtttcagaatcaatctccgaatctgtgtctgaatcaatcagtgaatcagtttctgagtcagtctcagaatcaatcagtgaatccgtctcagaatcaatttctgagtcagtatctgaatcagtatcagagtcactttcagagtccgtatctgaatccgtctcagagtcagtgtctgaatcgatttccgaatcagtatcggagtcaattagcgaatccgtctcagagtcagtatcagaatcaatctccgaatctgtgtctgaatcagtatcagagtcaatcagcgaatccgtatcagagtcagtatcagaatccatttctgagtctgtatcagaatcaatctcagaatccatttctgagtccgtatctgaatcagtatcagaatcaatcagcgaatccgtctctgagtctgtatctgaatccatttcagaatccgtgtctgaatcagtatcagagtcaatcagcgaatccgtatcagagtcagtttcagaatcaatctccgaatctgtgtctgaatcaatcagtgaatcagtttctgagtcagtctcagaatcaatcagtgaatccgtttcagagtcaatctcagaatcagtcagcgagtcagtcagcgaatccgtctcagaatcaatttctgagtctgtatctgaatccgtctcagagtcactttcagagtccgtatctgaatccgtctcagagtcagtgtctgaatcgatttccgaatcagtatcggagtcaattagcgaatccgtctcagagtcagtatcagaatcaatctccgaatctgtgtctgaatcaatcagtgaatcagtatcagagtcaatctcagaatcagtcagcgagtcagtgtctgaatcgatttccgaatcagtttcagaatcgatttcagaatcagtcagcgagtcagtatcagaatcaatttctgagtccgtctcagagtcagtgtctgaatcgatttccgaatcagtatcggagtcaattagcgaatcagtctctgaatccatttctgagtcagtttcagagtcaatctctgaatcagtatcagagtcaattagcgaatcagtctcagaatcaatttcagagtccgtatctgaatcagtatcagagtcaattagcgaatccgtttctgaatcaatctctgaatccgtctcagagtcaatttcagaatccgtgtctgaatcagtaagtgagtcagtttctgaatcaatttccgaatcagtatcagaatcaatcagcgaatccgtctcagaatcaatttctgagtccgtatcagaatcagtatcagagtctgtgtctgaatccgtatctgaatcagtttctgagtccgtatctgaatcagtctcagagtctgtgtctgaatcgatttccgaatcagtatcagagtcaatctcagaatctgtgtctgaatcaattagtgaatcagtatcagagtcaatctcagaatcagtctcagaatcaatttctgaatccgtctcagaatcaatcagcgaatcagtttctgagtccgtatcagaatcaatcagtgaatccgtttcagagtcaatctcagaatcagtcagcgagtcagtcagcgaatcagtatcagaatcaatttctgagtctgtatctgaatcagtatcagagtcaatttctgagtccgtatcagaatcagtatcagagtcaatctcagaatctgtgtctgaatcaattagtgaatcagtatcagagtcaatctcagagtcagtatcagaatcaatttctgagtcagtttcagagtcaatctctgaatcaatctctgaatcagtttcagaatcagtcagcgagtcagtttccgaatcagtatcagagtcaatctcagaatccgtctcagaatcaatttctgagtctgtatctgaatccgtctcagaatcaatcagcgaatccgtctctgagtctgtatctgaatcaatttcagaatccgtgtctgaatcagtatcagagtcaattagcgaatccgtctctgagtctgtatctgaatcaatttcagaatccgtttcagagtcagtaagtgagtcagtatcagaatccgtttctgaatcaatctctgaatcagtatcagagtcaatttcagaatccgtgtctgaatcagtatcagagtcaatcagcgaatcactatcagaatcaatctctgagtcagtttcagaatctatctcagaatcaatttctgagtctgtatctgaatcaatcagtgaatcagtttcagagtcaatctcagaatcagtctctgaatccatttctgagtcagtatcagagtcaatctctgaatcaatctctgaatcagtttcagaatcagtcagcgagtcagtttcagaatctgtatcagagtcaattagcgaatccgtctcagaatcaatttctgagtccgtatctgaatcagtatcagagtcaatctcagaatcagtcagcgaatccgtatctgaatcagtatcagagtcgatttcagaatccacatctgagtctctctctgagtcggtatccgaatcaatttccgagtcaagtgttgaagttcactctaatggtccaggtttagtaaatccaccactacctccaatagatatcgaatcagtttcagaatctattagccagtctttatctatttccgagtcggtgtccgaatcagtcagcgagtccgtctctgagtcaatctctgagtcagtatcagaatcaattagtgaatccgtttcagagtcaatctcagaatcagtgagcgagtcagtttcagaatcaatctcagaatcaatcagcgaatcagtctctgagtcagtatcagaatcaatcagcgaatccgtttcagagtcaatctctgaatcagtgagcgagtccgtatctgaatccatttccgagtcagaatcaaccccgtctcgtcaatctcaaactccgcgtagacaaggtgcgttgccaaatactggtgaacaatcatcagcttgggcaggaatccttggagcaggtcttcttcttggcggtttgtataaacgccgtaaaaaagaagaggaagatgtcgaggaaaatagtaattga

SEQ ID NO: 10 - protein, 2063 aa, Streptococcus suis
MERKNGKRYTEVSRKSRVKMHKSGKHWVRTVMSQLGLIQLGKRSASESPKIKLTSASQQESAAKMLRGLVAASAVVGGGLTAEQVLAEDTVIATEVTTSVLANEDTIRMSDAGTESDTSSQSVSESESTSHSESISDSESISSSESDSVSASTSESVSESESVSESESVSESESISFSESISFSESTSSSESTIASENSQSSSTTSELSESSTTDSTTSEETPQQVLEQVVSEAEILIQIAESKLEAAPDSDLAVAVAVSRTNLETAKQLLGNSNATITDIQTITSALQNSSQLLGLELLKNEEDGMITFALDTATTATVTKVGEGYGILVDTLSTATPAMTDANGAAISNPTNNTSFTPSSDSERYTFNYSKFNWFGDQLTDQTIKDNYYFRYSLDYDTTTTTTYVELVNKTNNTVVESHTLEKGQTATFTYFQNYSGANNRPLTITYGDSTSSSTTAGELQLQYNGGTLTNTLVPTYQEYTTYYKTTDGKTIATYTIKGIGGQMATPSAKRDFVGYDYASTTGGTPVRLYSPGTIYNDGAISTSYIKRLAEVVDEKGSLVKTVWVKDPTYTGTVDYNSTDTTGFIKVMETSVMAPGTANTSLVVPVTDVISAEESALATANAQAGKTGNDIFSVIYEDNYQLIRIGFDGYAKAAKSYPVSMLVQVILKSSHPDYAPNYTDSAGKVINPNTKGSSVRLENGLNSTTVNETTHWYTVDKPESESLSNSNSNSLSESESNSTSVSESISESVRESVSESISESVFESVSESISESVSESVSESVSESISESVSESVSESISESVSESISESVSESVSESISESVSESISESVSESVSESISESVSESVSESISESVSESVSESVSESVSESISESVSESVSESISESVSESVSESISESVSESVSESISESVSESVSESISESVSESVSESISESVSESVSESISESVSESVSESISESVSESVSESISESISESVSESVSESISESVSESISESVSESVSESISESVSESVSESISESISESVSESVSESISESVSESVSESISESVSESVSESVSESISESVSESISESVSESVSESISESVSESISESVSESVSESLSESVSESVSESVSESISESVSESISESVSESVSESISESVSESVSESISESVSESVSESISESVSESISESISESVSESVSESISESVSESVSESISESVSESVSESISESVSESVSESISESVSESISESVSESVSESISESVSESISESVSESVSESVSESISESVSESVSESLSESVSESVSESVSESISESVSESISESVSESVSESISESVSESISESVSESISESVSESVSESISESVSESISESVSESVSESISESVSESVSESISESVSESISESVSESISESVSESISESVSESISESVSESISESVSESVSESISESVSESISESVSESISESVSESVSESVSESISESVSESISESVSESISESVSESVSESVSESVSESVSESVSESVSESVSESISESVSESISESVSESISESVSESISESVSESISESVSESISESVSESVSESISESVSESISESVSESVSESVSESISESVSESVSESISESVSESVSESISESVSESISESVSESISESVSESISESVSESISESISESVSESVSESVSESVSESISESVSESISESVSESVSESISESVSESVSESISESVSESVSESISESVSESVSESISESVSESVSESVSESVSESISESVSESISESVSESVSESISESLSESISESVSESISESISESVSESISESVSESISESVSESISESVSESISESISESVSESVSESVSESVSESISESVSESISESVSESVSESISESVSESVSESVSESISESTSESLSESVSESISESSVEVHSNGPGLVNPPLPPIDIESVSESISQSLSISESVSESVSESVSESISESVSESISESVSESISESVSESVSESISESISESVSESVSESISESVSESISESVSESVSESISESESTPSRQSQTPRRQGALPNTGEQSSAWAGILGAGLLLGGLYKRRKKEEEDVEENSN

SEQ ID NO: 11 - DNA, 1260 bp, Streptococcus suis
  CDS (1)..(1260)
atgtttgcatcaatgaagaaaaaaatccgaagttcattaattttaaaaaggatactttggtcagttggtataatttttgtctatatgttagggaaatatattcctattgggacgttgccagtttattctgaaataggtgctggtgggtatgatttaacgagttctctagatactttagcgatggtatctggaggaaatttttctatgcagaatctattttcgttgggtttaagtccttggatgaccagcatgattctgtggcgttttttaagtctatttgaaattgtaaaggccgcgaccaaacgtcaaacccacttgtatcagatgaccttgatgtttatagttgccttgatacaggcctatggttttagtagtgtcagtgattactatgatattgtagagctgggtccggcaagtcaaacacttttgcgtctggcatccatggtcattatgattgcaggtagttttgtactgtcatggttagccaacctcaatgctcgaaaaggtgttggaggtccctcagtcattatcatttcaaatatgaccttgaactttttattgaatatcgttgcacttattagtcagaatagctttaatcctttggaatggatgttaatcgttttggcaatagttcttggggcaagtcttcttatctggataactttagtcgtttatagggcagagtaccgtattccaattcgacggatcatgattgtcagttcttttgcagagagaacttatattccaatcagattaacacctgctggagggatgcctttcatgtacgcaatgacattgatgccccttccgttgctattggctacaatacttttggaattctttcctgagaatcaatggctacaatatttttcagaaagcttcagtatttctcaattgccaggaatacttttttacatattcctattatttattctagcgattggattctcttactttaatttagatccaggggagattgctgaagggatgcaaaaggggggagatttcatcgaaggagtcagaccaggtcttgccacaaaaaaatatattaataaatatttgtggcggttaaccataattggtgcaatctacacagccattatgggtggattaccaattttaattgtctggagccaatcgggtcagataagttttgctttgttgattaataatatttatattatgacaacgctgatgcttggtattgttgagcaaattaatgtaatgctgacttggaaacagtataacgacttgatttaa

SEQ ID NO: 12 - protein, 419 aa, Streptococcus suis
MFASMKKKIRSSLILKRILWSVGIIFVYMLGKYIPIGTLPVYSEIGAGGYDLTSSLDTLAMVSGGNFSMQNLFSLGLSPWMTSMILWRFLSLFEIVKAATKRQTHLYQMTLMFIVALIQAYGFSSVSDYYDIVELGPASQTLLRLASMVIMIAGSFVLSWLANLNARKGVGGPSVIIISNMTLNFLLNIVALISQNSFNPLEWMLIVLAIVLGASLLIWITLVVYRAEYRIPIRRIMIVSSFAERTYIPIRLTPAGGMPFMYAMTLMPLPLLLATILLEFFPENQWLQYFSESFSISQLPGILFYIFLLFILAIGFSYFNLDPGEIAEGMQKGGDFIEGVRPGLATKKYINKYLWRLTIIGAIYTAIMGGLPILIVWSQSGQISFALLINNIYIMTTLMLGIVEQINVMLTWKQYNDLI

SEQ ID NO: 13 - DNA, 1572 bp, Streptococcus suis
  CDS (1)..(1572)
atgtattattttattccttcttggtacagtggagagcacaagtgggcagttgaaactccctattggtttcgagtatttgagaacatgagttttgatgatacggtcaatcaactaaaaatgtttcaaaatcttaaagaagaatcagctatactattgttaagctaccagcctcaattgagatattttgtacataagcagggattattaaatagtccgtactggtctttctttgatgatattcagaatattcgtagagaagaaacaaggtttattgactttaaagaatttgattggccccaaggtgttcgctttgtttatactccatttaaagtagttgtaatggagggagaagtctgcattgctgatgtacattttgcagagaacggcaacttacttcaaatccacttcttagatgaggagaaggaaacaaagagactgcaatttgatgatcgcggttttctgtctagtatacgctattataaagatggtattgctgcctatcaggactatctgaatgaatttggtgtatggcaggttcgtgaattattgacaagcaaagaacataaattggaagtcaatcctcaatcggataaacgatttcgaaaagctgtttatcaagattgggaagaattatttgctgaacgtttggaagttttgaagacggaagtcttatcagaacaggataccttagtggtagcttcagatatccgacataatgatttggtgttggatcaattcaaagcatacaaaaagattttttcattcttcggagatcgttttgatttaacgaatacacctgccttggctcgtgtcatggcagaatcggatttgattgtcattgattcagaggctctagaattagctttacaacaggagattgctaaacattctttagttgtacgtaatatgacgagagtgactccttttgatacccgtcttcgcttaggacaaagtcaaacgataaaagaattgattatttatttcctgattgatggtctttcgaaagaattagttgatcaagcgattgctattttgttggatgtgatggaagagaatcctgctattgagttacatttgttgacttacgaaagaaatcattcaatgaaacagttatctgaacaattgttagagaaaattcgtaagggctattcactagagcgttttgtttcggttgaatcaaaagacggtgagaatcagttagaggaagatgaatccctagaactttccgctatcaagtttttagcattaaacaatgaaaaccaaattatagaagaactagatttgacgcgtttggtgatagatttgagtccgaatccacacttgtatactcaaatagcaagtataagtgcaggaattcctcaaataaatagtgttccatctgaatatgtctctcatatggaaaatggctggattatcagaaatatggaagaattatcgacagcagtggggtattattttgatggcttaagtaattggaatcgctccttagtctatattgttcagaaaatgggtgattatacaagtggtaaaatcattgcaaaatggaaagaattattggaagatagaacatga

SEQ ID NO: 14 - protein, 523 aa, Streptococcus suis
MYYFIPSWYSGEHKWAVETPYWFRVFENMSFDDTVNQLKMFQNLKEESAILLLSYQPQLRYFVHKQGLLNSPYWSFFDDIQNIRREETRFIDFKEFDWPQGVRFVYTPFKVVVMEGEVCIADVHFAENGNLLQIHFLDEEKETKRLQFDDRGFLSSIRYYKDGIAAYQDYLNEFGVWQVRELLTSKEHKLEVNPQSDKRFRKAVYQDWEELFAERLEVLKTEVLSEQDTLVVASDIRHNDLVLDQFKAYKKIFSFFGDRFDLTNTPALARVMAESDLIVIDSEALELALQQEIAKHSLVVRNMTRVTPFDTRLRLGQSQTIKELIIYFLIDGLSKELVDQAIAILLDVMEENPAIELHLLTYERNHSMKQLSEQLLEKIRKGYSLERFVSVESKDGENQLEEDESLELSAIKFLALNNENQIIEELDLTRLVIDLSPNPHLYTQIASISAGIPQINSVPSEYVSHMENGWIIRNMEELSTAVGYYFDGLSNWNRSLVYIVQKMGDYTSGKIIAKWKELLEDRT

SEQ ID NO: 15 - DNA, 1578 bp, Streptococcus suis
  CDS (1)..(1578)
atgaagatagtacaaattggagaagaggactggtcagtcggtcttgatttgccagaagacttagaatggttttgggtgaccgaagataagattcaagatttcctggataatcaacaagcagcagaaatagctaaattacaagttgacgaatcagacgaggaaaaaacaccccctaaaattaggttgcgctataatgcaatagtgttgacaagctcaatcagagaagaactgcttttaccactgtcctcaacaattgaagcatatagtctatttaaacagaaggatgtaacagtggacaatcaatcggatactggtattagtcgccaaaaggtattgcgagaccttccttttcaaggttcaaaacaagaaacaattgagtatttatatcggaatctttttagtggtcagtatggggcgaagttaaaaattcctgagatagacgtcaatccgaactttaccggtaaggttcagtatgatgggaatgtgggggttatatttgatgggcaatttggtcaggattatgagaccttgttttcttttcgatataacctgtcatccttctctatgtccttagaattatggccagaatttatcaaggaatctggagatacatctatccgaatggaaatcattgcgcttcgaaaaggttccctaggggagatatacgaaatagtccatttagacgagacacagctattggagccctacgtattacaggctaatgaagaagttggtttttattccatctcatttgctgttaaaggtagaggacgattgaagttcggtgtgactcattggcgctatttgagagaaggattaggaaaatttattctgggaggaaagggctactcagattgtaagaggcaagaaatcttttcttacttcaatccaggagatatgaagccaccattgaatgtttatttttctggttttcgacaagcagaaggatttgaaggttttttcatgatgaaatcaatgggtgctccttttgtcctgatagcggatccacgtcttgaaggtggctgcttttattcgggaacggatgaattagaaaataatgtaaaacgcgccattcaagatgctttggattatcttggctttactagagatcaattgatcctatcaggcttgtctatgggagcatttggagcattgtactactcagcctattttcgacaacatgcattagtagttgggaagccattcacgaatcttggtgattctgttatgaacctgaaattaaaacgtccagacgaatttgaaaccagtggtgatatgattcgaaatgttgtcggtggatcagatcaggtggcaattgatcggttcaaccaacatttttgggataagtttgctcctgtctccttcgataggacacagtttgccattgcctatatggagcaggatgattatgatggacatgccttggaacgtttggtggaacatttggcagatagtgatacccacatttttgccaagggctacgaaggtcgacataatgataatagtcgggccattaaccgttggtttattgcacaataccatcattttctaaaaaataattttggaagggagctctaa

SEQ ID NO: 16 - protein, 525 aa, Streptococcus suis
MKIVQIGEEDWSVGLDLPEDLEWFWVTEDKIQDFLDNQQAAEIAKLQVDESDEEKTPPKIRLRYNAIVLTSSIREELLLPLSSTIEAYSLFKQKDVTVDNQSDTGISRQKVLRDLPFQGSKQETIEYLYRNLFSGQYGAKLKIPEIDVNPNFTGKVQYDGNVGVIFDGQFGQDYETLFSFRYNLSSFSMSLELWPEFIKESGDTSIRMEIIALRKGSLGEIYEIVHLDETQLLEPYVLQANEEVGFYSISFAVKGRGRLKFGVTHWRYLREGLGKFILGGKGYSDCKRQEIFSYFNPGDMKPPLNVYFSGFRQAEGFEGFFMMKSMGAPFVLIADPRLEGGCFYSGTDELENNVKRAIQDALDYLGFTRDQLILSGLSMGAFGALYYSAYFRQHALVVGKPFTNLGDSVMNLKLKRPDEFETSGDMIRNVVGGSDQVAIDRFNQHFWDKFAPVSFDRTQFAIAYMEQDDYDGHALERLVEHLADSDTHIFAKGYEGRHNDNSRAINRWFIAQYHHFLKNNFGREL

SEQ ID NO: 17 - DNA, 558 bp, Streptococcus suis
  CDS (1)..(558)
atgtcggagtattttgtacaaaaaatctattggggggatactgcaaatggcggtgactacctttatgggtcagaaatccaacacttcgacaatggtgttagatttagcaatcaacgatttgcatctggcaaaccgattaaaaaatgggaatcacggacgaattatcaaggaaatcgacgctctcctgtactccccttattacgaccaggggcttcttatcgattaaaacaaggttttcaagttgaaccggctggacgggcttacattcaactccgttttctcaaccaacgtggagatgaagtagggttaataattttaaaaaatggtgaagaggaatttacctgtccagttgattcttttacctatagcatcacactttgtagtgctggttgccacagtgttgatttttattatctatcactttatagtatggagaaaccacgagctattcatttatcggatgaaccaagaggcttttatgcaaatgaacggtaccctaaagatattgcatttgtaaaaaaattagttcaaaaacttaagaaggaggaagtgggttga

SEQ ID NO: 18 - protein, 185 aa, Streptococcus suis
MSEYFVQKIYWGDTANGGDYLYGSEIQHFDNGVRFSNQRFASGKPIKKWESRTNYQGNRRSPVLPLLRPGASYRLKQGFQVEPAGRAYIQLRFLNQRGDEVGLIILKNGEEEFTCPVDSFTYSITLCSAGCHSVDFYYLSLYSMEKPRAIHLSDEPRGFYANERYPKDIAFVKKLVQKLKKEEVG

SEQ ID NO: 19 - DNA, 2391 bp, Streptococcus suis
  CDS (1)..(2391)
ttgaaagtaaaaacaaattcttcttttttgaaccaagtaaggttatttaaaatcaaaagggtagcaaagaaaattcttcaattggaaactcaatatcatgagttatctgatgaagaactggcgaatcaaactgtttattttaaagagcgattagaacaaggagaaaccttagatgatttattaattgaagcttttgcaacggtacgtgaagcgagttttcgggtattgggacaacttccctatgaagtacaggtcatgggaggaattgcccttcatcagggctgtattgcagagatgcgtacaggtgagggtaagactttgacagccactatgcccctttatttgaatgccctcactggaaaaggagctattttagtaacaaccaatgattatcttgcaacccgtgatggtgaggaaatgggcaagatttatcaattcttaggtttgacagtggggcttggtgcaaaggaagaagatgagaataccgaggataaaaaggggcgagcaagcgtctatgaagcggatatcacctatacgactagttcaattcttggttttgactatctttcacataacttagcatcatctcctgaggggaaaattctccgtgacttcaattatgtcattgttgacgaagcggatgctgttttacttgatagtgcgcagacaccgttgataatatctggttcacctcgagttcagtcaaatttatttgatatttgtaatcaatttattcttactttaaaagaaggggaggaattcttttttgactccgataagaaagaagtttatctgactgaaaaggggaatgactacgcagaatcttattttgatattaaggacctctatacttcggaatcctgggagttaaatcgtcacatcaatttagctctacgagctcattatctatatcgtaagaattttgattatgttgtacaagatgatgaagtaaaattgttggacaataggacggggcgagtattagaagggacacgactccaatcaggtattcaccaagcaattgaaacaaaggaaaaagtcaaaaaaacaaaggaaagtcgcgcgatgggatcggtgacttatcaaagtctcttcaatatgtttcctaagattgctggtatgactggtacaggacatcaggcagaggatgagttgattgaaacctatcatgtacctgttatatcgataccgaccaataagccaatccagcgtatagactacccagataaaatttacacgaccttgccagaaaaactctatgcgacaattgaaatggtaaaagagctgcatgaaaaagggcagcctgttctacttatctcgggaacggtagaaattacacaaatttactcaaaaatgttgttgcaagaggggataccccacagtactttgacagccaataatgtggctaaggaggcgctaatcattcaagaagctggccaatatgggacggtaacttgtgctacgattatggctggtcgtggaacagacattaaacttggtaaaggtgttgcagagctaggagggttagcagttatcgggactgaacgtatgcccaatagtcgaatggactggcagttacgtgggcgtgcgggccgtcaaggcgaaccaggaatgtcacaattttttgtatcattggaagatgagttgctcgtcagcaatggtcctgcttgggtgaaaaagtatttcaaaaaacataatcatgaaaataggaataactatggccaaccgttgaaatcaggccgttttaatcgtgctctaacacatgctcagaccaaaagtgaggatggtgcgattagctctcgtcgctttacaattgaatatgatgaaagcatgcgcattcagcgaaacaaagtgtatgctctccgtgatcgattgatgatggagcaggaaaatctagctgagaaagtgaagacgattgtcaaagtagttattgaagattatttacaagaatatccagatcggacttctagtcaggttcgtcgttatattctagacaactatacttactcattgaagactatgccggatggattttctgcaaaaaaagataagcatgtaaaaaatctgctatatacattgtatgagaaagaaatggcaaagaaggctagtactgttcaaacacaagaagggatgttggagttctatcgcctagcagttctaaaggctattgacgaagcttggattgaggaggtagatagcttgcaacagttgaaaggtgtgatcacgacacgttcaacagcacaaaaaggaagtgtctccgagtactacaaagaatctttgcgctcctacaaggaaatgactcgacaaattcagcagaaaattgtacgtaatatcatgctaagtactatcgaagtagataaagagggaagattctctatttactttgtataa

SEQ ID NO: 20 - protein, 796 aa, Streptococcus suis
LKVKTNSSFLNQVRLFKIKRVAKKILQLETQYHELSDEELANQTVYFKERLEQGETLDDLLIEAFATVREASFRVLGQLPYEVQVMGGIALHQGCIAEMRTGEGKTLTATMPLYLNALTGKGAILVTTNDYLATRDGEEMGKIYQFLGLTVGLGAKEEDENTEDKKGRASVYEADITYTTSSILGFDYLSHNLASSPEGKILRDFNYVIVDEADAVLLDSAQTPLIISGSPRVQSNLFDICNQFILTLKEGEEFFFDSDKKEVYLTEKGNDYAESYFDIKDLYTSESWELNRHINLALRAHYLYRKNFDYVVQDDEVKLLDNRTGRVLEGTRLQSGIHQAIETKEKVKKTKESRAMGSVTYQSLFNMFPKIAGMTGTGHQAEDELIETYHVPVISIPTNKPIQRIDYPDKIYTTLPEKLYATIEMVKELHEKGQPVLLISGTVEITQIYSKMLLQEGIPHSTLTANNVAKEALIIQEAGQYGTVTCATIMAGRGTDIKLGKGVAELGGLAVIGTERMPNSRMDWQLRGRAGRQGEPGMSQFFVSLEDELLVSNGPAWVKKYFKKHNHENRNNYGQPLKSGRFNRALTHAQTKSEDGAISSRRFTIEYDESMRIQRNKVYALRDRLMMEQENLAEKVKTIVKVVIEDYLQEYPDRTSSQVRRYILDNYTYSLKTMPDGFSAKKDKHVKNLLYTLYEKEMAKKASTVQTQEGMLEFYRLAVLKAIDEAWIEEVDSLQQLKGVITTRSTAQKGSVSEYYKESLRSYKEMTRQIQQKIVRNIMLSTIEVDKEGRFSIYFV

SEQ ID NO: 21 - DNA, 1500 bp, Streptococcus suis
  CDS (1)..(1500)
atgacaatttacaatattaaccgaggtatcggttgggccagtagtggcgttgagtatgctcaagcctatcgcgcgagcatactaagaaatattcagcaagacagtaaatttatttttacggatacgttccaaggtgaaaaccttgcacattatacagctaatattggttttcaagacgaggaagtagtatggctgtatggattttttactgatgtgaaaaccagatcgacaacctataccattggtcagtttgaatcgagtttatcatctggtatggttaaaatctcacaaaacaaagacaccattcgctatgaagataaagataagagtgttgtagctgtaggttttctgagaaaagatcatccagactatgtacaacgtgtcgaatacctatccaaagggaaactgattcgtaaagactattttagttatacaaaaatgttctctgaatactatgcacctgtagacaatcagcctaagttgtatcaacggacattcttcaatgaagatggcagtgtagcctatgaagaaaactgtgatggtgaaaagtctctattccgtttcaaggatacaattttattttcaaaagaagaattgattggctatatgttggattgtttgcagttgaccagtcaagatattattcttgtggatcgagcgacgggaacaggtcaagctattcttcgtcataagggagctgcaaaggttgctgttgtgattcatgcagaacactacaacattaattcaatgacagaggataccattctctggaataactattatgaatatcagtttaccaatgctgataaaattgacgccttcatcacatccacccaggctcagaaagatacgctgtctgctcaatttaaaaaatatacaaatatagatccagctatttttgtcttgccagtcggtagtttagataaattgcgtcattcagccgaaggaagacgtcctttctcgcttcttacctgttcacgtttagctgcagaaaaacatattgattggttagttgaaggtgtcgtcttagcgcagaagcaactacctgacctaacatttgatatttatggtgctggcggccagcaatcgaagttggcaagtatgattgagcagcatcaagcacaaagttatattcatctcaagggccaccatgatttgactgatatttatcagcagtatcaagtatatctgactgcctcaactagtgaaggctttggtctgactctgatggaagctatcggctccggtttgccgattattggtctggatgttccgtacgggaaccaaacctttgttgaaaatgaaaaaaatggttctcttattccgagacaggacccagatgatgccattatctatgcacaagaatttgcaaagcgcttgattcaactgtatcaatctaaccaattggatgcctggcatcaggcttcttacaagcgggcagaagaatttctaactagtcgtctagaagaagcttggcaaacatttatcgaggaggtgtaa

SEQ ID NO: 22 - protein, 499 aa, Streptococcus suis
MTIYNINRGIGWASSGVEYAQAYRASILRNIQQDSKFIFTDTFQGENLAHYTANIGFQDEEVVWLYGFFTDVKTRSTTYTIGQFESSLSSGMVKISQNKDTIRYEDKDKSVVAVGFLRKDHPDYVQRVEYLSKGKLIRKDYFSYTKMFSEYYAPVDNQPKLYQRTFFNEDGSVAYEENCDGEKSLFRFKDTILFSKEELIGYMLDCLQLTSQDIILVDRATGTGQAILRHKGAAKVAVVIHAEHYNINSMTEDTILWNNYYEYQFTNADKIDAFITSTQAQKDTLSAQFKKYTNIDPAIFVLPVGSLDKLRHSAEGRRPFSLLTCSRLAAEKHIDWLVEGVVLAQKQLPDLTFDIYGAGGQQSKLASMIEQHQAQSYIHLKGHHDLTDIYQQYQVYLTASTSEGFGLTLMEAIGSGLPIIGLDVPYGNQTFVENEKNGSLIPRQDPDDAIIYAQEFAKRLIQLYQSNQLDAWHQASYKRAEEFLTSRLEEAWQTFIEEV

SEQ ID NO: 23 - DNA, 1314 bp, Streptococcus suis
  CDS (1)..(1314)
atgattttattatttgattattttcatacagctagtcaagatttgtactactccttgaagcaagcagggcttacaggctctactgttgccatcaacgatgatggttttttgccagaaggtgtgacatccgtttattcatactattgccaaatggaagccggtcacggaaaacctctttattttaatcagataaaggtgccaccattctgggaaattacaggcactaacggtgagggagaaatctgggaatatagcgaaaaacgtgcgaaaattttctatgcagagcccaagcatttacgacatgtgaagaatgttgattggatggataagaatgaaaaagttcgttttacagaccattacaatcaatatggctggctctatgctcggacctattttactgcagaacaaaaggcaacaacgcgtagttattttactcgcgaaggcttggaagtcattgtagaaaactttatgactggcgatgttatcctaaattggcaaggaaagactcatttttttgaaaatcgtgtagcatttttaaaacactattttaaagagatgggctgggacacttcgcaaatttggtataattccctgtcgactccttttttcctatcttacaatatgccacaaccaggacaggatattcttttctggcaggaaacgataggagaggatattcctggtaatatgaaaattttactggctagtgatactcaacgcacccagaccgtcgtggttcaggataaggctacttttgaaaagatgcggacacttctgcctgcagaacaggctgaaaagttagtgtatcttggctatatctaccctcaaagacgtgagaatcagaacagacaagacatcttcatttttacaaactcggatcagattgagcaactggactatttgacgactgctctgccgaatttcaaattccatattgctgccttgactgaaatgtcacagcgtttgatggcttttgataccaaggacaatgttcaactttacccaaatatttcacaaagggcgcttgaacgattatatgatacctgtgacatctatttggacatcaatcatggaagtcaagtaatggaagtagttcggaaagcctttgagcaaaacatggcgatttttgcttttgaaaatactgttcataatgcttcgttaattattaaagatcatattgtaccacaggcagaaccacacaaattagtagaactactgaatgcgaatgctgggcgactgactgacaaggtccttgaacagcgcactcatacaagtaatgaatttgtagaaaactatgtagctatcttaggctag

SEQ ID NO: 24 - protein, 437 aa, Streptococcus suis
MILLFDYFHTASQDLYYSLKQAGLTGSTVAINDDGFLPEGVTSVYSYYCQMEAGHGKPLYFNQIKVPPFWEITGTNGEGEIWEYSEKRAKIFYAEPKHLRHVKNVDWMDKNEKVRFTDHYNQYGWLYARTYFTAEQKATTRSYFTREGLEVIVENFMTGDVILNWQGKTHFFENRVAFLKHYFKEMGWDTSQIWYNSLSTPFFLSYNMPQPGQDILFWQETIGEDIPGNMKILLASDTQRTQTVVVQDKATFEKMRTLLPAEQAEKLVYLGYIYPQRRENQNRQDIFIFTNSDQIEQLDYLTTALPNFKFHIAALTEMSQRLMAFDTKDNVQLYPNISQRALERLYDTCDIYLDINHGSQVMEVVRKAFEQNMAIFAFENTVHNASLIIKDHIVPQAEPHKLVELLNANAGRLTDKVLEQRTHTSNEFVENYVAILG

SEQ ID NO: 25 - DNA, 1596 bp, Streptococcus suis
  CDS (1)..(1596)
ttgattaaagagaagtgtatagatgatttgacaatctataataaaccagaaggacaggtgccgcgttctgccattatccttgctgcagggttcggtctacgaatgattccgataaatattgatagaccaaaagccttattgtccatcaatggtgaaatagttattgaacgcctcatcagacaattacgagaagctggggtggagtctataacagttgttgtaggctatatgaaggatgagttaaactacttaaaggagaagtatgatatcaccttggtagaaaatgcagattattatgagagtaataatttgtactctcttttcttggtctcagagaaaatttctaatacttttattctaccaagcgatatttggtgtagaacaaatccgtttctatcggatgaaacggactcttactatatgatttatgaggatggggaaagccgtaagaaggaatattggggtgctatgactggtattgcttatattgatcataaagatggggaaaaacttagacaattactacatgccatagtagatagtgagttggcgaaaacagcattttgggaagaagcgctttatgacagtcagtcattgtggattcgccccaaaattgtccccttggatagtattaggcaaatcaatacttttgaggatttaagagagttagatagtcattcagaacatctacagtcagaggttgttgatattatctgtcaaactttgcaggtggaaacaaaagatatcagtggaataactgctttgaaaaaaggaatgactaaccgttcctttctattttcttgtggaaataaaaagtatatcatgcgcattcctggagaaggaacagatttgttgataaatcggcaacaggagttctccgtctatggaactctggcaggtaccgatatatgtgatgaagttgtttatattaatccagagaaaggctacaagattacaagatttattgaaaatgcaagaagttgtgacttgaataatcggcttgacttagaaaagtgcatgtcaaagttgcgagaatttcatgcattagaacttcaggtcaatcatgattttgatatttttgagcaaattgatttttatgaaactcttttagatggagctaaatctatatacagtgactatgagcatattaaaaaacgagtcttcagccttgcgacctatattgataaacatacagatagaaaagttttgacccatatcgatgctgttccagataattttttgatttactctgaagatggagtagaagaaattcgtttgattgattgggaatatgcaggtatgcaagatccacatgtagatatagccatgttttgtatctattctctctataacaaagaacaaattgatgagctgatagatatttatttcaggggttgctgtcctacagaaattcgtatcaagatatattgctatattgctgcttgtggcttgctttggagtaactggtgtgagtacaagcgaagtttgggagttgattttggtgagtatgctactagtcaatataaatatgctaaagagttcagtttagttttggagaacaatagtatcgtggaggaagtatggcatctaaagtaa

SEQ ID NO: 26 - protein, 531 aa, Streptococcus suis
LIKEKCIDDLTIYNKPEGQVPRSAIILAAGFGLRMIPINIDRPKALLSINGEIVIERLIRQLREAGVESITVVVGYMKDELNYLKEKYDITLVENADYYESNNLYSLFLVSEKISNTFILPSDIWCRTNPFLSDETDSYYMIYEDGESRKKEYWGAMTGIAYIDHKDGEKLRQLLHAIVDSELAKTAFWEEALYDSQSLWIRPKIVPLDSIRQINTFEDLRELDSHSEHLQSEVVDIICQTLQVETKDISGITALKKGMTNRSFLFSCGNKKYIMRIPGEGTDLLINRQQEFSVYGTLAGTDICDEVVYINPEKGYKITRFIENARSCDLNNRLDLEKCMSKLREFHALELQVNHDFDIFEQIDFYETLLDGAKSIYSDYEHIKKRVFSLATYIDKHTDRKVLTHIDAVPDNFLIYSEDGVEEIRLIDWEYAGMQDPHVDIAMFCIYSLYNKEQIDELIDIYFRGCCPTEIRIKIYCYIAACGLLWSNWCEYKRSLGVDFGEYATSQYKYAKEFSLVLENNSIVEEVWHLK

SEQ ID NO: 27 - DNA, 921 bp, Streptococcus suis
  CDS (1)..(921)
atggcatctaaagtaaaaggaacagttcaaggtttactgtccggtatgttttggggattgggtacatccttgaatagcttaatattgttaatggttcctttcgttgtagaggatagcaagctattatcctctacgttactattagcattttttcatgatttcttttctgctatttttttaacaattgacttatctattagaggttgttttaaaaatacgatacaaatttggaaaactagaagtgcttattttgtaatgatagcagcagtattcgctggtccgttagggatgagagcctatctttttgcagttgaaaagttgggtgctggtttaacagcaacaatatctgctatatatcctgcaatatctgctttattaggaatgatttttttaaaagattatttgacaagaaagggatggtttggactagctttaaccatcttggcagttatttttcttggatatagtggcttttctcaaatagaagaattattcattggctctttagcagcattgctatgtgtaattggttgggcttcagagagtgttattaccgcttatggtatgaaagaagatattttacctaaacaagctttatttatcaggcagtggacttcaagcttagtctacctgttgtttatgataatagagggggatgttggttacagtatagcaactgtttttagttcacagtctattctttttatcgtttgtctctccgttataggaacgctttcatatttattttattattctgctattgatactataggtccagtaagagcgacaggtttaaatgtcacttattctatttggacagttatcttttcactgtttcttttcggtggtcaattagatataaagttaatcatcagtagtatagttattgttattggtacactatttgttttgaaaaactaa

SEQ ID NO: 28 - protein, 306 aa, Streptococcus suis
MASKVKGTVQGLLSGMFWGLGTSLNSLILLMVPFVVEDSKLLSSTLLLAFFHDFFSAIFLTIDLSIRGCFKNTIQIWKTRSAYFVMIAAVFAGPLGMRAYLFAVEKLGAGLTATISAIYPAISALLGMIFLKDYLTRKGWFGLALTILAVIFLGYSGFSQIEELFIGSLAALLCVIGWASESVITAYGMKEDILPKQALFIRQWTSSLVYLLFMIIEGDVGYSIATVFSSQSILFIVCLSVIGTLSYLFYYSAIDTIGPVRATGLNVTYSIWTVIFSLFLFGGQLDIKLIISSIVIVIGTLFVLKN

SEQ ID NO: 29 - DNA, 690 bp, Streptococcus suis
  CDS (1)..(690)
atgagagcaattattttagcagcaggaatgggaactagattaagacccttgactttaacaactcctaaatctttgattgaagttggaggtcaaacattaatagaaagacaaattttatttttaaatgaaattggtatttcggaaattattattgtaacaggttatttatcagaaaagtttgacttcttagagaataaatatggtgtaaaattaattcataatgataaatatgatacctataataacttttatagtatgtatcttgtacgggattttttgagtgatgcttatgtaattgatgcagacaattatctgcacacgaacttcttagattctgatgtgaccatttctacatatttttcagcttataagagaggttttgaagatgaatggcttttaaaatgcgatgataatggtctagtgaaagaaattgtgatagatagtggtgagggctcaattctatctggggtatcatattgggatgcaaaatctggtcaggttctaaaaaaacttattgaagagatattagaatcaaatgatttttgtaatttatattgggataatcttgtaaaagataacttggataagttgatagtatataagagagatattccttcgaatgttatatttgagattgataatcttaatgatttcgtccagctacaaaaatttttaagttcccatacctag

SEQ ID NO: 30 - protein, 229 aa, Streptococcus suis
MRAIILAAGMGTRLRPLTLTTPKSLIEVGGQTLIERQILFLNEIGISEIIIVTGYLSEKFDFLENKYGVKLIHNDKYDTYNNFYSMYLVRDFLSDAYVIDADNYLHTNFLDSDVTISTYFSAYKRGFEDEWLLKCDDNGLVKEIVIDSGEGSILSGVSYWDAKSGQVLKKLIEEILESNDFCNLYWDNLVKDNLDKLIVYKRDIPSNVIFEIDNLNDFVQLQKFLSSHT

SEQ ID NO: 31 - DNA, 963 bp, Streptococcus suis
  CDS (1)..(963)
atgggaggtacacgtgatacctctacatctactacacaaggagaaataatgaaaacattcttgagaagaaaaggaatcgcctgtcagcttctagccgccatttttattgtcggtatcaatttacaatccccaccttcagcctcagccaatgcaagaggagatgactatccctacacagcagttgatgcagtcgatccatggagactctacacacgccagtgcacctcctttgtagcctttcgacttagcacagttaacggttttacattgccacctgcctatggtgatgccaatgtttggggccatcgtgccaaacaagaaggttatcaagttaatatgacacctgctgtcggagccgttgcctggtgggaaactcccatgcatgtcgcatgggtttctgcagtaaatggagataccgtagagattgaggaatacaactacggtgttcgctatacctacggaaggcgagttatccccaaaaatgccgttagcggctacattcattttaaaaacctcggagctggaacaaccaactctcaacccgccttagccccaagcggcacctatacttttaacagccaactagccatcaaatctcaagctagtctatctagtcctaccctcgattactattatgctggcgaaagcgtccgctacgacaaggttcttgaagccgacggacaacgctggattagctatatcagctattctggagctcggcgctatatcgccatccagcctacgattactcaatctacaaacaatagcctaccagcatcaggtagctacaccatccagtcctactctagtgtccgcaacaatccaagtctgtccagtcctgaaatcaccttctacggagctggctcagtcgttcgctatgataaagttattactgccgaaggtcgcacatggattagctatatcagttactcaggtgctcgacgctacatcgccatctcctaa

SEQ ID NO: 32 - protein, 320 aa, Streptococcus suis
MGGTRDTSTSTTQGEIMKTFLRRKGIACQLLAAIFIVGINLQSPPSASANARGDDYPYTAVDAVDPWRLYTRQCTSFVAFRLSTVNGFTLPPAYGDANVWGHRAKQEGYQVNMTPAVGAVAWWETPMHVAWVSAVNGDTVEIEEYNYGVRYTYGRRVIPKNAVSGYIHFKNLGAGTTNSQPALAPSGTYTFNSQLAIKSQASLSSPTLDYYYAGESVRYDKVLEADGQRWISYISYSGARRYIAIQPTITQSTNNSLPASGSYTIQSYSSVRNNPSLSSPEITFYGAGSVVRYDKVITAEGRTWISYISYSGARRYIAIS

SEQ ID NO: 33 - DNA, 43713 bp, Streptococcus suis
ttaatcccgttttgttttttccttgatccattgactaacgttggacagggctttgctttgctctgccttgcgtttttgttcgtggacaaaatctgcaaagctttgcttgacgccgtccttttgaaccttgtcctgcaaatcatgccatttctttttaaggttgctggaagtccgttcgtaataaatctctaaaatttcttcttttgacttataattgcgatagaaagcgttgcgagaaactcccgcttttcggaccaattcagataccgaaatttgcttgagctcctttttctctaggagaaatagcagagcagtttctattgattccttagtcagttgatttgcttctttatttgattgatagaggtttttcaaagattggggtgaaattttacgacctgccatagttttccttttccgagtgtcacatctgaaagaaaatgctttcagacggggtagtttaatgatataattgtaagtaaatagagatttattgtcaaataaaaaagtaaaattggaaatgagaatattatgacaaaatggaaaattgttgcagattcgggctgcgactatcgtcaattagctaatctagctccggacactgaatttattagtgtgccacttaccatccaagttggagaacaagcatttgttgatgatgcaagcttagatattgatcacatgatggaggtgatggaagcatctaagtctgcagcggggtcggcgtgtccaagtccgcaggcttatcaggcagcttttgagggagctgagaatattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgtagacgaaatcaatcgcttaattagtgcaggattagattttccacaagtagtagaagcgataactcactatcgggaacacagtaagctcctctttgttttagcgaaagttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctacgaagtgaaagcgtgattcacagagtaataattttgggctgtaatttccgctatagaataatccccctcgtcttctaagttcgcgggggattgtttgtatgagactattggatttcattcattcaaatatcttacgaattgctccagtttatctgcaaaatcttgttcaaagaagatctgtaagaaatcagctttctgtccgctgaaataataacattttccaaacatgtgttgtatgctaggagaaagaatccccttgcttagctgaaaggtcacgctccctttggaaattcgatacgggatgtttaaagcgtatttctctagacagtcttttattttattccattgagcgtgataaatgtgatgaagatgctgtgtgttccgtgcaaacataccgttatcaatgtagagcgagagagctttttgcatgataagattggtatcgtagtcgattagactcttatgtttgatgaagatatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatctgctaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaattccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcttttagacaaatccgaaaatcttcatagggtaattcttgaaagtctgtaggattgagctctacagtatggtcttggaaatctctatcctctaagatataataaccgcttttttcgacagcgtagatcttattttggtattttaattccaacatagccttttggacagtgtctttgctacaatgatattgctcgcggagttgacggatagaaggtaatttctctccacgtttgaatcgatgttcctctattccagtcaaaatatcttggatgataacttgatattttttcatctaggtcccctttttatagactatgttactagctagtatatagaaaaaattgaagaaagacaatatatgaataatggggttgaggttcaggaattaagctactctatggtataattaagtgatgaaaataattatacctaatgcaaaagaagtaaatacaaatctagagaatgcctcgttttatctcctgtctgatcgaagcaagccggtgctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggcagaggaagattgctgtcctggttggctaagaacaatattcaggaattatcggacattcaagattttaaggtggatggctttgaatattgtacttccgaatcaacggcaaaccaacttaccttcatacgatcaataaaaatgtgaaattatgaaaaagataacgttttccagcgctaaaaagggtagaaaaatattaatttctatgatataatggatgcgttataggtaaaagtctaggaaggttgtttatgaaaaagagaagcggacgaagtaagtcgtccaagttcaaattggtaaattttgcgcttttgggactttattccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcgctcttacttgttttttcactggtcatcacgtctgttgggatctatggaatgcaagaagttgtaaaattttcaacacgactaaattcaaattcgacattttcagaatatgaaatgagtatccttgtcccagcaaatagtgatattacggacgttcgtcagcttactagtatccttgctccagccgaatacgaccaagataacatcaccgctttattggatgacatatccaaaatggaatctactcaactagcaactagccccgcgacctcttacctgacagcatatcaatctatgttgaatggcgagagtcaagcgatggtgttcaacggagtttttaccaatattttagaaaatgaagatccaggcttttcttcaaaagtgaaaaaaatatatagtttcaaagtgactcagactgttgaaacagctactaagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctggtatctacggtgtcaatgcttctgtgcacaccttagaaaatctctatgggattgacattagcaattatgtgcggttgaacttcatttccttccttcaattaatcgacttggtgggtggaattgatgtatataacgatcaagaatttacaagtttacatgggaattatcatttccctgttggacaagttcatttaaactcagaccaagcattaggcttcgttcgagagcgctactctttaacagggggtgacaatgaccgtggtaaaaaccaggaaaaagtgattgctgccttgattaaaaagatgagtacgccagagaatctaaaaaattaccaggcaatcctatctggattggaaggctcaattcaaacggatttgagcttagaaacgattatgagtttagtgaatacccaactagaatcaggaacacaatttacagtagagtcacaagcattgacaggaacaggacgctcagacttatcttcttatgcgatgcctggatcacaactttatatgatggaaattaaccaagatagtctggagcaatcaaaggcagcgattcagtccgtacttgttgaaaaataaagattttaggagaaaatatgaacaatcaagaagtaaatgcaatcgaaatcgatgttttattcttactaaaaacaatttggagaaagaaatttttaattctcttaactgcagtgttgactgcggggttggcatttgtctacagtagttttttagtgacacctcaatatgactccactacccgtatctatgtagtgagtcaaaatgttgaagccggtgcgggcttgactaaccaagagttacaagcgggtacctatttggcaaaagactatcgggaaattatcctatcacaagatgtattgacacaagtagcaacggaattgaatctgaaagagagtttgaaagaaaaaatatcagtttctattcctgttgatactcgtatcgtttctatttctgtgcgtgatgcggatccaaatgaagcggcacgtattgcaaatagccttcgcacctttgcagtgcaaaaggttgttgaggtcaccaaggtaagcgatgtgacgacacttgaagaagcagtcccagcggaagaaccaaccactccaaatacaaaacgaaatatcttgcttggtttattagctggaggtatcttggcaacaggtcttgtactggttatggaggttttggatgaccgtgtaaaacgtcctcaggacatcgaagaggtaatgggattgacattgctaggtatagtaccagattcgaagaaattaaaataggagaacaatatggcgatgttagaaattgcacgtacaaaaagagagggaataaataaaaccgaggagtatttcaatgctatccgtaccaatattcagcttagcggagcagatattaaggttgttggtattacctctgttaaatcgaatgaaggtaagagtacaactgcggctagtctcgctattgcctatgctcgttcaggttataagaccgtcttggtggatgcagatatccgaaattcagtcatgcctggtttcttcaagccaattacaaagattacaggtttgacggattacctagcagggacaacagacttgtctcaaggattatgcgatacagatattccaaacttgaccgtaattgagtcaggaaaggtttctcccaaccctactgcccttttacaaagtaagaattttgaaaatctacttgcgactcttcgtcgctattatgattatgttatcgttgactgtccaccattaggactggtaattgatgcagctatcattgcacaaaaatgtgatgcgatggttgcagtagtagaagcaggcaatgttaagtgctcatctttgaaaaaagtaaaagagcagttggaacaaacaggcacaccgttcttaggcgttatcttgaacaaatatgatattgccactgagaagtatagtgaatacggaaattacggcaaaaaagcctaatttctcagataacataagtttgataagtaggtattaatatgattgatatccattcgcatatcatatttggtgtggatgacggtcccaaaactattgaagagagcctgagtttgataagcgaagcttatcgtcaaggtgttcgctatatcgtagcgacatctcatagacgaaaagggatgtttgaaacaccagaaaaaatcatcatgattaactttcttcaacttaaagaggcagtagcagaagtttatcctgaaatacgattgtgctatggtgctgaattgtattatagtaaagatatcttaagcaaacttgaaaaaaagaaagtacccacacttaatggctcgtgctatattctcttggagttcagtacgaatactccttggaaagagattcaagaagcagtgaacgaaatgacgctacttgggctaactcccgtacttgcccatatagagcgttatgatgctctggcatttcagtcagagagagtagaagagctaattgacaagggatgctacactcaggtaaatagtaaccatgtgttgaagcctgctttaattggcgaacgagcaaaagaatttaaaaaacgtactcgatattttttagagcaggatttagtacattgtgttgctagcgatatgcataatttatatagtagacctccgtttatgagggaggcgtatcagcttgtaaaaaaagagtatggtgaggatagagcgaaggctttgttcaagaaaaatcctttgttgatattgaaaaatcaagtacagtaacctcatagaaatagtggaggagctatgaatattgaaataggatatcgccaaacgaaattggcattgtttgatatgatagcagttgcgatttctgcaatcttaacaagtcatataccaaatgctgatttaaatcgttctggaatttttatcataatgatggttcattattttgcattttttatatctcgtatgccggttgaatttgagtatagaggtaatctgatagagtttgaaaaaacatttaactatagtataatatttgtaatttttcttatggcagtttcatttatgttagagaataatttcgcactttcaagacgtggtgccgtgtatttcacattaataaacttcgttttggtatacctatttaacgtaattattaagcagtttaaggatagctttctattttcgacaacctatcaaaaaaagacgattctaattacaacggctgaactatgggaaaatatgcaagttttatttgaatcagatatactatttcaaaaaaatcttgttgcattggtaattttaggtacagaaatagataaaattaatttaccattaccgctctattattctgttgaagaagctatagagttttcaacaagggaagtggtcgactacgtctttataaatttaccaagtgaatattttgacttaaagcaattagtttcagactttgagttgttaggtattgatgtaggcgttgatattaattcattcggttttactgtgttgaagaataaaaaaatccaaatgctaggtgaccatagcatcgtcactttttccacaaatttttataagcctagtcacatcttgatgaaacgacttttagatatacttggagcagtagtcgggttaattatttgtggtatagtttctattttgttaattccaattattcgtagagatggtggaccagccatttttgctcagaaacgagttggacagaatggacgcatatttacattctacaagtttcgttcgatgtttgttgatgccgaggtacgtaagaaagaattaatggctcaaaaccagatgcaaggtgggatgttcaaaatggacaacgatcctagaattactccaattggacacttcatacgaaaaacaagtttagatgagttaccacaattttataatgttctaattggagatatgagtctagtcggtacccgtccacctacagttgatgaatttgaaaaatatactcctagtcaaaagagaagattgagttttaaaccagggattacaggtctttggcaagtgagcggaagaagtgatatcacagattttaatgaagtcgttaggctggacctaacatacattgataattggaccatctggtcagacattaagattttattgaagacagtgaaagttgtattgttgagagagggaagtaagtaagactcctttaaaacaaagaatagtaagtagtaggggatatgagaacagtttatattattggttcaaaaggaataccagcaaagtatggtggtttcgagactttcgtagaaaaattaactgagtatcagaaagataaatcaattaattattttgttgcatgtacaagagaaaattcagcaaaatcaggtattacaggagaagtttttgaacataatggagcaacatgttttaatattgatgtgccaaatattggttcagcaaaagccattctttatgatattatggctctcaagaaatctattgaaattgccaaagatagaaatgatacctctccaattttctacattcttgcttgtcggattggtcctttcatttatctttttaagaagcagattgaatcaattggaggtcaacttttcgtaaacccagacggtcatgaatggctacgtgaaaagtggagttatcccgtccgacagtattggaaattttctgagagtttgatgttaaaatacgctgatttactaatttgtgatagcaaaaacattgaaaaatatattcatgaagattatcgaaaatatgctcctgaaacatcttatattgcttatggaacagacttagataaatcacgcctttctccgacagatagtgtagtacgtgagtggtataaggagaaggaaatttcagaaaatgattactatttggttgttggacgatttgtgcctgaaaataactatgaagtaatgattcgagagtttatgaaatcatattcaagaaaagattttgttttgataacgaatgtagagcataattccttttatgagaaattgaaaaaagaaacagggttcgataaagataagcgtataaagtttgttggaacagtctataatcaggagctgttaaaatatattcgtgaaaatgcatttgcttattttcatggtcacgaggttggaggaacgaacccatctttacttgaagcactttcttctactaaactaaatcttcttctagatgtgggctttaatagagaagtaggggaagaaggagcgaaatactggaataaagataatcttcacagagttattgacagttgtgagcaattatcacaagaacaaattaatgatatggatagtttatcaacaaaacaagtcaaagaaagattttcttgggattttattgttgatgagtatgagaagttgtttaaaggataagttatgaaaaagattctatatctccatgctggagcagaattatatggggcagataaggttctcttggaacttataaaaggcttagataagaatgaatttgaagcgcatgttatcctacctaatgatggagtcctagtgccagcattaagagaagttggtgcgcaagttgaagttattaactatccaattctacgtaggaaatattttaatccaaaagggatttttgactacttcatatcatatcatcactattctaaacagattgctcaatatgccatagaaaataaggttgacataattcacaataatactaccgctgtcttagaaggcatttatctgaagcgaaaactcaaattacctttgttgtggcatgttcatgagattattgtcaaacctaaattcatctctgattcgatcaattttttaatggggcgttttgctgataagattgtgacagtttcacaggctgtggcaaaccatataaaacaatcacctcatatcaaagatgaccaaatcagtgtaatctacaatggggtagataataaagtgtattatcagtccgatgctcggtctgttcgagaaagatttgacattgacgaagaggctcttgtcattggtatggtcggtcgagtcaatgcgtggaaaggacaaggagattttttagaagcagttgctcctatactcgaacagaatccaaaagctatcgcctttatagcaggaagtgcttttgaaggagaagagtggcgagtagtagaattagaaaagaagatttctcaattaaaggtctcttctcaagtcagacgaattgattattatgcaaataccactgaattatataatatgtttgatatttttgtacttccaagtactaatccagaccctctaccaacggttgtactagaagcaatggcatgcggtaaacctgttgtcggttaccgacatggtggtgtttgtgagatggtgaaagaaggtgttaacggtttcttagtcactccgaactcaccgttaaatttatcaaaagtaattcttcagttatcggaaaatataaatctcagaaaaaaaattggtaataattctatagaacgtcaaaaagaacatttttctttaaaaagctatgtaaaaaatttttcgaaagtctacacctccctcaaagtatactgattggctgaagtgaatgctttagtatagcgatttatcgtattatcattcgataaaacaaatgttcagaaacagttataagttatttctaaagggcacctctataaactcccaaaattgcgaatttggagttacgaaagccttgttaaatcaacattttaaattttagaaaattagtttttagagctcccctaaaatagaagataacagaagggagccttcaaaaacttcatttttaattggattgtagaaaaactgttaaatcaatatttagatttttaggagttcagttttttgggggagagcttaataatctatgcactatatttcgaaaaatatatggtgtaaaatcagaactgatggtcgtggcaaaaaagagaatgaggaatttatgaaaattatttcttttacaatggttaataacgaaagtgagataatagagtcatttatacggtataattataactttattgacgagatggtcattattgataatggttgtacagataacacgatgcaaattatttttaatttgattaaagagggatataaaatatccgtatatgatgagtctttagaggcatataatcagtatcgacttgataataaatatctaacgaaaataattgctgaaaaaaatccagatttgataatacctttggatgcggatgaatttttaacagccgattcaaatccacggaaacttttggaacaactggacttagaaaagatacattatgtgaattggcaatggtttgttatgactaaaaaagatgatattaatgaatcgtttataccacgtagaatgcaatattgttttgaaaaacctgtttggcatcattctgatggtaaaccagttactaaatgtataatttccgctaagtattacaaaaaaatgaatttaaagctatcgatgggacatcacactgtttttggtaacccaaatgtaaggatagaacatcataatgatttgaaatttgcacattatcgagctattagccaagagcaattaatttataaaacaatttgttacactattcgcgatattgctactatggagaacaatatcgaaacagctcaaagaacaaatcagatggcgctcattgaatctggcgtggatatgtgggaaacggcgagagaagcctcttattcaggttatgattgtaatgttatacatgcaccaattgatttaagtttttgtaaagaaaatattgtaataaaatataacgaactatccagagaaacagtagcagaacgcgtgatgaaaacgggaagagaaatggctgttcgtgcatataatgtggagcgaaaacaaaaagaaaagaaatttctaaaacctattatatttgtattagatgggtttaaaggagatgagtatattcatcccaatccatcaaatcatttgacgattttaaccgaaatgtataacgtcagaggcttacttaccgataatcaccaaattaaatttctcaaagttaattatagattaattataactccagattttgctaagtttttaccgcatgaatttattgttgtaccagataccttggatatagagcaagttaaaagccagtatgttggtacaggtgtagacttgtcaaagattatttctttaaaagagtatcgaaaagagataggctttattggtaatttgtatgcgcttttaggatttgttccgaatatgctcaatagaatctatctatatattcagagaaacggtattgcaaacactattataaaaatcaagtcgagattgtgagagttgtttacttttatttgtaattttaaaagtaatgcaggcagataggagaaaaacgtttggaaaaatgagaataagaattaataatttgttttttgttgccatagcgtttatgggcataattattagtaattcgcaagttgttctagcgataggcaaagcttctgtgattcagtatctatcttatttagttttgattttatgtatagttaatgatttattaaaaaataacaaacatattgtagtttataaattagggtatttgtttcttattatatttttatttactatcggaatatgtcagcaaattcttcctataacaactaaaatatatttatcaatttcaatgatgattatttcagttttagcaacgttgccaataagtttgataaaagatattgatgattttagacggatttcaaatcatttgttattcgctctttttataacttcgatattaggaataatgatgggggcaacgatgttcacgggggcagtagaaggtatcggttttagtcagggttttaatggaggattgacgcataagaacttttttggaataactattttaatggggttcgtattaacttacttggcgtataagtatggttcctataaaagaacggatcgttttattttaggattagaattgtttttgattcttatttcaaacacacgctcagtttatttaatactattgctttttctatttcttgttaatcttgacaaaatcaaaatagaacaaagacaatggagtacgcttaaatatatttccatgctattttgtgctatttttttatactatttctttggttttttaataacacatagtgattcttacgctcatcgcgttaatggtcttattaatttttttgagtattatagaaatgattggttccatctaatgtttggtgcagcggatttggcatatggggatttaactttagactatgctataagggttagacgcgttttaggttggaatggaacgcttgaaatgcccttactgagtatcatgttaaaaaatggttttatcggtctggtagggtatgggattgttttatataaactttatcgtaatgtaagaatattaaaaacagataatataaaaacaataggaaagtctgtatttatcattgtagtcctatctgcaacagtagaaaattatattgtaaatttaagttttgtatttatgccaatatgtttttgtttattaaattctatatctactatggaatcaactattaacaaacaactgcaaacataaattggcaggaatagagttttgagttgctattaatttggtagagcatatgttctataggtggcaagatagaagatagtattttttacatgatgatttttatgatagcaaagcaagttacggcataaaaggaattagaggatggaaaaagtcagcattattgtacctatttttaatacggaaaagtacttaagagagtgtttagatagcattatttcccaatcgtatactaatctagagattcttttgatagatgacggttcttcagattcatcaacggatatatgtttggaatacgcagagcaagatggtagaataaaacttttccggttaccaaatggtggtgtttcaaacgcaaggaattacggtatcaaaaatagcacagcaaattatattatgtttgtagattctgatgatattgttgacggcaacattgttgagtccttatacacctgtttaaaagagaatgatagtgatttgtcgggagggttacttgctacttttgatggaaattatcaagaatctgagctgcaaaagtgtcaaattgatttggaagagataaaagaggtgcgagacttaggaaatgaaaattttccaaatcattatatgagcggtatctttaatagcccttgttgcaaactttataagaatatatatataaacaaaggttttgacactgaacagtggttaggagaggacttattatttaatctaaattatttaaagaatataaaaaaagtcagctatgtaaacagaaatctttattttgctagaagaggtatacaaagtactacaaatacgtttaaaaaagatgtttttattcaattagaaaatttagaagaaaaaacttttgatttgtttgttaaaatatttggtggacaatatgaattttctgtttttaaagagacgctacagtggcatattatttattatagcttattaatgttcaaaaatggagatgaatcgcttccaaagaaattgcatatatttaagtatttatacaataggcattctttagatactctaagtattaaacgaacgtcctctgtttttaaaagaatatgtaaattaattgttgctaataatttgtttaaaatttttttaaatactttaattagggaagaaaaaaataatgattaacatttctatcatcgtcccaatttacaatgttgaacaatatctatccaagtgtataaatagcattgtaaatcagacctacaaacatatagagattcttctggtgaatgacggtagtacggataattcggaagaaatttgtttagcatatgcgaagaaagatagtcgcattcgttattttaaaaaagagaacggcgggctatcagatgcccgtaattatggcataagtcgcgccaagggtgactacttagcttttatagactcagatgattttattcattcggagttcatccaacgtttacacgaagcaattgagagagagaatgcccttgtggcagttgctggttatgatagggtagatgcttcggggcatttcttaacagcagagccgcttcctacaaatcaggctgttctgagcggcaggaatgtttgtaaaaagctgctagaggcggatggtcatcgctttgtggtggcctgtaataaactctataaaaaagaactatttgaagattttcgatttgaaaagggtaagattcatgaagatgaatacttcacttatcgcttgctctatgagttagaaaaagttgcaatagttaaggagtgcttgtactattatgttgaccgagaaaatagtatcacaacttctagcatgactgaccatcgcttccattgcctactggaatttcaaaatgaacgaatggacttctatgaaagtagaggagataaagagctcttactagagtgttatcgttcatttttagcctttgctgttttgtttttaggcaaatataatcattggttgagcaaacagcaaaagaagcttctccaaacgctatttagaattgtatataaacaattgaagcaaaataagcgacttgctttactaatgaatgcttattatttggtagggtgtcttcatcttaattttagtgtctttctgaaaacggggaaagataaaattcaagaaagattgagaagaagtgaaagtagtactcggtaagaatgttgtaataaatggttgaaagaaaaggggattaaaatgaatccaacaaatagtagaatagcactctttgatacgattaaatgtatcatggtactttgtgttatttttacacatctggattggtctgttgagcagcgtcaatggtttatctttccgtatttcgttgacatggctgttccaatttttctgttgctttctgcctattttcgaacgaataagtggaatacaaaacaagagacgctaaagctcaagttcagcagtggtataaaagaaagtataaacatgctttgtctctatgctatcgtgatggctgttaatgttttattgagctattcgagaaccatctgataggagtaaagcctttttcaggttcttcatcgctccgttcatttgtcctgtggctactttctggagaatcgggtccagggagttgggagttactatgttccgttgttgattcaggtagtttttttattaccaattttgtatgttcttttcgagaaaaataaatggttgggcttgcttacttgttttttagtaaacttttcagtggatgccatatttgctaacatggctgaacacggcatatatatatagactaatatcacttcgttatctttttgttctagggcttggttttttctttcaaagcaggatgtgcgttccaaggtagatactttcattgcgaccctatttgggattattggagcaattctgatttttgtgaatcattctatagagcccttctcctggttttatggttggaagtctacttcctttctatgcgtcccatttgcgtatgctatgctattttttatgataaagtatggacagaagattccagcaacactgttgtcaaaattgggagttgcttcttatcatatctacttgacccagatgctgtatttttcagtagtcgcaccatttttagcagtgcaatttaaggtatcttcgttgaatttgtggaacggcttgtttacctttctaatttgcctgtttggtggctatattttctacaaagtggatctgtttatgagagtacgtggaaaacgataatgactcatttcagattagcagatgccatttcgtttattagcagattcgcatgttaatattccgacaaagaaattcaaataggttgacgagagaggagtggtatctgtttctaaaccccagtatccccctttattttcaaagctatatttattaactgaacaaggagaatttttaagagaactgtttgtttaatcccagcacgatctggttcgaaaggcttaccgaataaaaacatgctatttttggacgggaaacccatgatttttcacacgattgatgtggcaattgaatcaggttgttttgagaaagaagacatctatgtcagtacggattcagaaatgtataaggggggcacctctataaattcccaaaattgcgaatttggagttacgaaagccttgttaaatcaacatcttaaattttagaaaattagtttttagaggtccccaaggggatttgcgagacaagaggcatcaatgtattgttaagacccaaagaactatctacttatcatactccatcgaatgaagtcagtacgcacttttttacgaatctggattttatgaagattgtatatttgttcttctgcaagtcacctcaccgttacggactggcgaacagataaaagaagccattaatatgtacttacagggggactcagaaaatgttttgcatttcaatgatgaagggcaagaaagagtgaatcagtacattatcgaagctgtacaggggttataaaaaggggttacttatccttaaagtctgtatgtagaaggagaaaaattgagacgaatttatatttgccatacgatgtatcagatcctgatttccttgttaaagatggacgttgagagagatagtttgatgtccgttgatatcatcgggcattttccagatgtcagggagcaactgcagcagcatgttcatctaatcgaggagacggagcgttcatttgatctatattctttgatagctagatcaaaaacaaaagaacgcctttccttgttacagagctatgacgaggtgatcatttttcaagatcaccgtcaagtcggtcattttttaaataaacatcggattccctattctcttttggaggatggttataattttttcaaggataaaagagtgtgcgatttggagtcaattcaatcatctgtctggaaaagactcttttatcaatggtattttaaaccaacatatttgattggttcaagtctctattgtcaatccattgaggtcaatgatctgtcgctcgtacaatttgacgaggcttataaaccctttgtagaagttccgagaaagcaattatttgatcaagcatcgccagagaaggtgcaagcgctgctgcagatatttggagcaagggcgatagtagcggatgaggagtcttctcaaaaacgattgctattattgacccagcccttgtcttgggattatcatgtgaccgaagaggagttgttggagatttatgtagcaggtcttgccccttatcgagaagactatacaatctacataaaaccgcacccacgagatggggttgattattcatttctgggtaaggctgtggtgcttctgcctcaaggtattccgtttgagttgttcgaaatggcaggtagtatccgttttgatatcggtatgacctatagttcgtctgctttagattttttaaattgttttgaagagaaagtgtatttaaaggacacttttcctcttctttcaaaaaatgatattttgcgtgaggggatagaataggaggattcatgtctaaaaaatcaatagttgtctcaggtctcgtctatacgattggaaccatcctcgttcagggattagccttcattaccctccccatctatactcgtgtcatttctcaggaagtatatgggcagtttagcttgtataattcgtgggtggggctagttggtctctttatcggtctacagttaggtggggcttttggcccgggatgggtacacttccgcgagaaatttgatgatttcgtatccaccttgatggtctcttctatcgctttctttttaccaatttttgggctatcttttctcctcagtcagcccctatcgctcctatttggtttgcctgattgggtcgttccgcttatctttttgcaaagttttatgagtgttgtgcaaggattttttacgacctatttagtgcagcggcagcagtccatgtggactttactcctatcggtactgagcgctgttattaacactgctttatctttatttctcatcttttcgatggagaatgatttcatcgctcgtgtaatggcaaactcggcaacgactggtgtttttgcttgtgtgtccttgttgtttttctataagaagattgggcttcattttcgaaaggactatcttcggtatggtttaagtatatcgattcctcttatttttcatggattaggtcataatgtactcaatcaatttgacagaatcatgctcggcaagatgctaacactgtcagatgtagccctatacagtttcggctacacacttgcgtctatcttacaaattgtgttttcgagcttgaatacggtatggtgtccgtggtattttgagaaaaagagaggtgcagataaagatttgctcagttatgtcagttactatctggcgattggcctgtttgtgacttttggatttctaacaatttaccctgaattagcgatgttgttaggtggatctgagtatcgtttcagtatgggatttattcccatgattattgtcggggtgttctttgtatttctttatagttttccagccaatatccagttttatagtggaaatacaaagtttttgccaattggtacttttatagcaggtgtactaaatatttcagtcaactttgttttgataccgacgataggaatttatggtgctgctttggcaacgactgcttcctatctgttgttgctagtcttgcattattttgttgctaagaaaaagtatgcttacgatgaagttgcgatttcaacatttgttaaggtaattgctcttgttgtcgtctatacaggcttgatgacagtatttgtcggttcaatctggattcgttggtcactaggaatagcggttctagtcgtttatgcctacatttttagaaaggaattaacagttgccctcaatacattcagggaaaaacggtctaaataagggcacctctataaactcccaaaattgcgaatttggagttacgaaagccttgttaaatcaacattttaaattttagaaaattagtttttagaggtccccatataaaaacgtcccaaatgagaggtgctcataagaattgaccatcactgccatctacccaaagttcaagtattctctaccatgaaaattgtgctataatcaagtataaagaagggaatgtttcttaaaggacgtatgcgcctctgcttatgccagaagtcatgaggtaaatctccctaaaaattgggtagaaaagcagattaaacttccaccaatctattgaagatcgtgtgaagaagcaggctttagaagcaacaagccctgagactattcgaaagaaatctagggctattttttctaatcggctatcagaagtgaagtagcgatttttattagtgttcttttactacttaaggaaaaccaagctgctccctcaagactttatgggagcgatttacagtcatttttagaaaggaaataaaatggtttatattattgcagaaattggttgtaatcacaacggtgatgttcatctagcacggaaaatggtagaagttgccgttgattgtggtgtggatgccgttaaatttcagacatttaaggcagatttgttgatttcaaaatacgcaccaaaggcagaataccaaaaaattacaacaggagagtcagattctcagctcgaaatgactcgtcgtttggaattgagctttgaagagtatcttgatttgcgtgattactgtcttgaaaagggagttgatgtgttttcgacaccttttgatgaggaatcattggacttcttgattagcacagatatgcccgtttataagattccatctggtgagattaccaatcttccctatttggaaaaaattggtcgtcaagctaagaaagttattctttcaactggtatggctgttatggatgaaattcatcaagcggtgaagattttgcaggaaaatggaacgaccgatatttcgattttgcattgtacaaccgagtatccaaccccttaccctgctttgaatttgaatgtcttgcataccttgaaaaaagaatttccaaacttaacaattggctattcagaccatagtgttggttcagaagtacccatcgctgctgcagcaatgggagctgaattgattgaaaagcactttactctggacaatgaaatggaaggaccagatcataaagcgagtgctactcctgatatcttagcagccttggtaaaaggagtgaggatagtggaacaatctcttggtaaatttgaaaaagagccagaagaagttgaagtacgaaataaaattgtagctagaaaatctattgttgccaaaaaagcaattgctaaaggcgaagtctttacagaagaaaacatcactgtcaaaagaccaggaaatggaatttcgccaatggaatggtacaaagtcttggggcaggtgagtgagcaggattttgaggaagaccaaaatatttgccatagtgcttttgaaaatcaaatgtaagcggagtaaggatgaaaaaaatttgttttgtgacaggctctcgtgccgaatatgggattatgcgtcgcttattgagctatctacaggatgatccagaaatggagctggatcttgtagtgacagccatgcatctagaagaaaaatatgggatgacggtcaaagacatcgaagcggacaagcgtaggattgtcaagcggattccattgcatttgacggatacgtctaagcagacaatcgtcaaatctttagcgaccttgacagagcaactcacggttctttttgaagaagtccagtatgacttggtgttgattctgggggatcgctatgagatgctaccagttgccaatgctgcgttgctttataatattcctatttgccatattcatggtggtgaaaaaaccatgggaaattttgatgagtcgattcgccatgccattaccaagatgagtcaccttcatctgacatcaacggatgaatttagaaatcgtgtcattcaactaggagaaaatcccaaccatgtactgaacatcggagctatgggtgttgaaaatgttttaaaacaagactttttgacaagagaagagttggcgatggaacttggaattgattttgccgaggattactatgttgtactctttcaccctgttaccttggaggataacacagccgaagaacaaacgcaggccttattagatgctctaaaagaagatggtagccagtgtttgataattggatccaattcggatacacatgccgataagataatggaattgatgcatgaatttgtaaaacaagactctgattcttacatctttacttcgcttccaactcgttattaccattccttggtcaagcattcacaaggtttaatagggaattcttcgtcaggtttgattgaagtgccctcattacaggttccaaccttaaatattggaaatcgccaatttggacgtttgtcaggaccgagtgtggtacatgttggaacttctaaggaagcgattgttggtggtttggggcaattacgtgatgtgatagattttaccaatccatttgaacaacctgattctgctttacaaggttatcgagctatcaaggaatttttatctgtacaggcatcaaccatgaaagagttttatgatagataggggagaaagtttgatgaaaaaagtagcctttctaggagcgggtaccttttcagatggtgtccttccttggttggatagaagtcgatatgaactcattggatattttgaagataaaccgatcagtgactatcgtggctatcctgtatttggtcccttgcaagatgtcctaacctatttggatgatggaaaagtagatgctgtcttcgtcactataggtgacaatgtcaagcgcaaggaaatctttgacttgcttgccaaagatcattatgatgctttgttcaacatcattagcgagcaagccaatattttttccccagatagtatcaagggacgaggggttttcataggtttttcaagttttgtaggagccgattcctatgtctatgacaattgtatcatcaatacgggtgccattgtggaacatcataccacggtggaggcccattgtaacattactccaggagtgaccataaatggcttgtgccgtatcggagaaggcacttatattggaagtggttcaacagtgattcaatgtatcgagattgcaccttatacaacattgggggcagggacagttgttttgaaatcgttgacggagtcagggacctatgttggtgtacctgctagaaagattaaataggtgaattgatggaaccaatttgtctgattcctgctcggtcaggatcaaaaggtttaccaaataaaaacatgttatttttagatggtgtaccgatgattttccataccattcgagctgcgattgagtctggatgttttaagaaagaaaatatatatgtcagtactgattcagaggtttacaaggaaatttgtgaaacaactggggttcaagtcctcatgcgtccagctgacttggcgacagattttacaacctcttttcaactgaacgaacattttttacaagatttttctgatgaccaagtatttgttctcctgcaagttacgtccccattaagatcgggaaaacatgtcaaggaggcgatggagttatatgggaaaggtcaagctgaccacgttgttagctttaccaaagtcgataagtctccaacattgttttcaactttagacgaaaacggattcgctaaggatattgcaggattaggtggcagttatcgtcgtcaagatgagaaaacactctactatcctaatggagcgatttatatttcttctaagcaggcttatttagcggataaaacttatttttctgaaaaaacagcggcctatgtgatgacgaaggaagattcgattgatgtagatgatcactttgattttactggtgttattggtcgaatttactttgattaccagcgtcgtgagcaacaaaacaaaccattttataaaagagagttaaagcgtttatgtgagcaacgagtccatgatagtcttgtgattggcgatagtcgtctgttagccttgtcactggatggtttcgataatatcagcatcggtgggatgacagcttcgacagcacttgaaaaccaaggtctctttttggctactccgataaagaaagttttgctttctcttggtgtgaatgatttgattactgaccatcccttgcatatgattgaggatactattcgccagctgatggaaagtcttgtttccaaagcagagcaggtttttgtgacgacgattgcctacacgctgtttcgtgatagcgtttcaaatgaagaaattgtgcagctgaatgacgttattgttcagtcagcaagtgaactgggtatttcagtgattgatctaaatgaagttgttgaaaaagaggcgatgcttgactatcagtataccaatgatggattgcatttcaatcagattggacaagagcgtgtgaatcagctgattttgacaagtttgacaagataatttggtgatagaagctatttcagtggctagactatgttggtatgtgttttagagccaaggaataacatctgtagaggatgctagccttgagaattgacaaccatttagttgtttaattatataaggggacctctaaaaactccctaaatttcccaaaaatgagataatagaataaaaagtaatgaggagagctgtcatgcatttattcacagacgatgaaaaaatcttgtcaaaactatcagagaaaggcaatcccttagaacgtttggatgccgttatggattggaatatctttcttccattgttgtcagagttattcagtcgtaaagataaagtcatcagtcgtggcggtcgtcctcacctagactatctcatgatgttcaaagcgctcttgcttcaacgtcttcataacctatctgacgatgccatggaatatcaactgctggatcgtatatcttttcgtcgttttgttggttgtcatgaagacactgttcccgatgcgaaaactatctggctctatcgtgagaaattaaccaagtcaggtcgtgaaaaggagttgttcgatttgttctatgcccatctcacagatgaaggggtgattgcccattcaggtcagattgtggatgctacctttgtcgaatgccctaaacaacgcaattcacgtgaggacaatcagaaaatcaaaacttatcgaaaattatgaggtcacaacagctagtgtacacgactccaatgtcctagctcctctttgtgatgccaatgaagcggtttttgatgacagtgcttatgttggaaaatcagtaccagaaggttgtcgccaccacacgattcgtcgtgcttttagaaataaaccgttgactgagactgataaggtcattaatcgacatattaccaaagtccgttgtcgcgttgagcatggttttggcttcattgaaactaacatgaaaggtaacatctgtcgagcaattgggaaggcacgagctaaaaccaatgtgaccttaaccaacctgctctacaatatctgtcgttttgagcaaatcaaacgactgggattaccatcgtgggcttagtgcgcccaaaaataggaaaataagcaaaaagaggctgggcaaaaactagtttctcacaataaaaaaacggctctttgtcaactgtagtgggtagacgaaaagctaacacctagagaggacgaaattcgttctctcatttttgatgtttaaagcgtaaccgcctaataacaaggtatctatccaatcacacattcctccattatactgttatatagtcaactgaaacaagagcaggacgaaagtacctcaagaaaagtatcgcaatttggcaatactcttctgaggtgttttttgatgtgagcccatattttctcaatgggattatattccggtgagtaaggaggaagtggtaaaagtctatgtccctgctcctcgcataaatcttttagcttactcatcctatgaaactttgcattgtccatgatgataacagatggtttacctaaagtgggtagtaagaatgttttgaaccaagcttcgaaaaagccactcgtcatagtatctttgtatgtcatcggggctataagcgcaccatttatgagacctgccactaaagatatccgctggtatcttcttccagagaccttaccttttatcaactgacctttcaaagagcgaccatattctcgatgaaaacatgtctcaaaccctgtctcgtcaatataaacaggagtcaagtggcttaagttattcaattctttaaggaacagttctactttttcagggtcttgttcatagtaggtacagctcttttttttcgagtatatcccatagctttgagggcgtaatgaatagctgttggatgacagtcaaattcagaagctatttcagtcaaataagcatctggatgagtttcaagataatatctctatccacttttcttggcttggttcctttaacttggtgatgaagctcgccggttttctcttttaattttagccattgatagatagtgttacgtgaaacttggaaaatagctgatgcttcagtaatactgccggttttctcacagtatgcgagaacttttttacgaaaatctaatgaatatgccataaatacattatatcataaatgtactgtttttgtttcatttaactataaaaaacaaactggaggattcattatgtcacagcccgtcgtccaattgactattccccaatctcgccgttttgaaaagaaaagcagaaacgatattctgatgaaaattcgtctcggaaaaacggaagtcacattcttccaatctatcaaccctgaagtaatggaaacaatcttggataaggtgctgcattatgaccatccgactcagtgatttaggtcaagtcttcttggtctgtgggaaaacggatatgcgtcaggggattgactctctcgcctatcttgtcaaaagtcaatttaatctggatcccttttcaggtcaggtctatctcttctgcggaggtcgaaaagaccgattcaaagctctttactgggatggacagggattttggttattgtataaacgttttgaaaatgggaaattgacctggccaaacaatgaagaggaggttaagtccctcacttccgaacaagtagattagctcatgaaaggattttctatcattccaaaaataaatgtttcaaaaagtcgtgatttctattgaaatcatggcttttctttgtgtataatgagataaaaagaaggaggagcgagcgtatggatgagttgttggcaattattaaacaacagacttcaacgattgaacaacttaccaatgagctaaccctccttcgagaacaggttgactatctgagacagaaactctacggaaaatcatcagagaaagttgtgtatcaacccggtcagctgagcttgtttggggaggaaagcctccctgaagaagaagctgacttacccagttgaaacagagatcatcacttataaacgcaagaaaactaagggagttcgtcaggctatttttagtcagttcactccagagatagtgcatcacgaattgcagggcgaagactgcacttgtccagactgtcatggtcagttgaaagagattggctcagctgttcaacggcaagagttggtcttcattcctgcacaattaaagcggattgaccatgttcaacacgcatacaagtatcaggcatgtagccagaagaatctgagcgataagattatcaaggctcccgttcctaaggcacctttggcacacagcttgggttcagcctctatcatcgctcataccattcatcagaagttcaatttgaaggtgccaaattaccgtcaggaagaggattggcataagcttggcctgcccatcagtcggaaggaaatagccaactggcatatcaagtctagtcagtattatttcgagccgatttacaacctgttgcacgagaaattgttggagcagcctattctccatgcggatgagaccgcctacaaggtcttagaaaatgatggtcagttgaccttctactggaccttcttgtctgggaaacatgaggaaaatggaattaccctctatcatcatgacaaacgacggagtggcttggttgtggaggaggttcttggggactatgcgggctacgtacattgtgacatgtggagtgcttatcgtcaattagacaaggctcagctggttggttgttgggctcccgtcaaacgaaagttctttgaggcgactcctaagaagacagacaagacttctttaggagccaagggcttagactattgcgaccgcctgtttgccttggagagcgactgggctgacttgtctagcgaggagcgactgcataaacgctggctcccttgatggacgagttctttgactggtgtcgtgagcaatctgttttgccaggctccaaattgggtactgctttggagtatagcctcaaatacgaaaccaccttccgaaccgttctctcggatggtgacttggtcctgtctaacaacgtggctgaaagggctatgaagaccttggtgatgggcagaaaaaattggttgttctcccaaagttttgagggagccaagtcgacagctatcattttgagtcttttggaaacggccaagaggcacgaacttgatacagagaaatatatgacctatcttctagacaatctacctaacgaggaaacactcgctaaaaaagaagttctagaggcttatttgccatgggagaagaaaattaagagagcatgtaaatagaaaaaggttccagagtcaacaggactttggagccttttcaatataccttattattgggcggttacaaagtagcctaggaaacgaagccgaagatagaactggagttggagttcataaaggcaagttgacaacggataattttgattttcgaagagtatcaataaaaatcaaaaacagcaagtctaagctacttatgaaagttctataatgaagtcaaacgtgggacaactttacaacaagtccgaaaagggctgtacaaaaaagtctattctgctgactatgcacaaacggtataccaaactaatcgaaaacgatcggtaaaaaagataatcctaacgaaagaattgaaagagaaaattttacactatactaagcaaaaattttctcctgaaatgatggttaagaagaaaatgaaagtgggtatttcaaccatttactattggtttcatcatggccatttaggattgacgaaagcagatatgctttaccctagaaaagggaaaagggtcaagaagcaagctagtcctaactttaaaccagcaggaaaatctatcgaagaacgtcctgacgttattaatcttcgcttggaaaacggtcattatcaaattgatacagttctactaaccagagggaaaaatcattgcctcttagtcttaaccgaccgacgaagcaggcaccaaatcatacgattaattccaaacaaaaccgccgaatcggtcaatcaggcactggagggaatcttgagggaacatcgtatcctgtctataactgtagataatggtacagaatttagtcgtctggctgaagtgttacctgaggagtatatctactatgcgcatccctactcttcatgggagaggggaacgaatgaaaatcacaatcgattgattcggagatggttacctaaaggaaccaagaaaacgactccaaaagaagtcgcttttatcgaacattggatcaacaactaccctaaaaaatgcttggactacaagtcgccgagtgaatttcttatgggtggctaatttcaacttgaaatttggggtctaagctatttataacatttgaaaccttaatttataagtttgagttgaggattgtggatttcaagcagctgttttcttctaaaaaaataacaaaatcgaaacggtccatatccactttgagtggtagttggctatttttgattttaaatgagtatcacaccccatcgtcccattgactgttccccaatctcgccgctttgagaagaaaggcagaaatgatattctgatgaaaattcgtctcggaaaagtggaagtcacattctttcactctatcaaccaagaaacattagaaacaatcttagataaggtactattttatgaccatccgactcagtgattaggtcaagtctacttggtttgcgggaagtagtggtgtgatttggttaagaggattatgctcacttagaatttctacctgcttgctttgagagacatgagtgtagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagacttaagcgcacactttgttctttaagatgatcatcgtttttcacactggtaaatagataactagaatgatgcgctatatagtcttcaagtaacgaaagtgtttcatcgtttccaatatagagtagtcgcactttctttcctttttcgagtatttgaatggttctatttttcaaattgatattatcaagttttaaattacataattcagagatgcgtagaccagttgataaaagtagcgagataaggagtagatttcgcatagctttccgcttagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagtcttttttatatgttggttgagaaaagtaagataggacctaatatcattggtcctaaagctataatactaatgtaaattggatttgtatgcttggatagtatgagaactaagtcgtctttgaatagcacaaaagtcaagatatctctggatagtgtcgtaattcataatataatctccttaatatgtcgtaataaagctattatatacgataatttatcaatttactaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctgatcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgttgattccctctttttgcgattactttagcattaattatacaggttcaaatgcactaacagtttcattatgtcgtaataaatttatttgaggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtccctttttttaatattaaagggaaatatcttgtattagatccagtcaaaattgtctcttcttcagaaattataacaagcaaactatctgataataatagttattcatttgaatggttggaatatcaacaaatatgtacaaaattaaaagagtcaacaaaaaaaactcgccaagtacttaggtataaccacttacggacgagttgattttagaataaagtcagatgggagttattttgtttttgatattgcaacaatgccttacacaagtgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcacctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctattaaatgaggtaatagcatgtaaatacatgaaagatagtgaataggttcaacaataacatctttggcgctttcagctaatatattttcgttaagtgtatcacaaagtgaatgaaaagaaaaatcttgtgatgtatttccttgaaagttaatatcattctttaataatatcgaagataataacgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattgcctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaatttttctgcaaatgaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattctaatgagacataattaaactttcctaccgataacaatttattatcattagtataccataatctacatttgttttatagattttattaaaatttttatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaggaagcgtagaaaaactaaagggaacgattcgtgtcccaggtgataaatcaatcagtcatcgttctattatttttggttcccttgcaaaaggtgttacccgtttccacgatattttacgtggggaagatgtcttgtcaaccatgcaggtctttcgtgatttgggtgtaaaaattgaagacaatggtgatattgttgaagtacacggtgttggctttgatggtcttcaagcccccaaaaatgatttggatatgggaaattctggaacctcgattcgtttgatttcaggcgttttagcaggtcaagactttgaggcgactatgtttggtgatgattccttatccaaacgtcctatggaccgagtaactattccactcagtcaaatgggagtagagatttctggacaaactgaacgtgacctacctccgttgaccatcaaagggaataagaatttaaaaccaattcgctaccaactccctgtagcctctgctcaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcataccaggttcaaaaattgtccttgaaaatgtgggaatcaatgaaactcggactggtattttagatgtcattaaagctatgggtggtaaaatgactctttctaacatagatgaacttgcaaaatctgctaccattacagttgaaacgtcggaattgaaggctacggagattgcaggcgaattgattcctcggttgattgatgagttgccgattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaagaattgctggacttacctagtaattgtatcgtatcaactggtggtggtgtgattaaatctgaagtaaacagggaattgctgttggcaaatagggaggacaatgtacttcttactgcctcctttgaagtttcctatcagagaattcgtaaggatagacagtcgcaaagacctctctttttacagtgtagtaaggaagagtttgaagccctctatcgtgaacgaatggcactttatcaaggtttagccgatactgtaatcgatacagataaactgattccagaacaagtagcaaggaaaattttatgcaagtagcctatctaggacctcgtggttcttttacacatcaagtggcccagcaggtctttccgactgcggatttgcaggcttttgagacgattacagaggttatcaaggcctacgaaacgggggaagttacctattccgttattccagtagaaaactcgattgaaggtagtgttcatgaaacgattgactacctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagttagtacagcctatgctgctcgctttgtggcagaacaccctgaacaaccatttgcggcaattgctccgcaagcggcagcagttgaatatggactggaagtaattgcgcaagacatccaggaaatcagcgagaattttacacgcttttggattttgggggataaggctccgtctattgccctggaacaagtagctaaaaaagtcagtcttgcactgactttgccagataacctgccaggagccttgtataaggccatgtctgttttctcatggagaggaatcagcttaacaaaaatagaaagccgacccctgaaaacggctttgggtgagtattttttcatactggatcttgacaatcagtctgaggaattattaacctattctcaaaaagaattgactagtttagatataacctataaagtattagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggattatctattatataaaaaagagctgagagaacggcatggaagtccaaggcaatctctacgtagcttcacaccaacggcttatgaagatgactacttcgaggaagattattttgaagaggatgatgagcaagaggaactgttgcctcgctatcctgaacgtaaatccagaaaaacaagacaagccaaacctcaacggtttcagtctcctcgtatcggtcccaaagcgaaagtacctaaacctaaaaaagctcgtaaaaagggtggtttcaagcgctttattggtttcgtattgcttgctatagcgctagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggtgaaagctcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaatagttttgacattgatatcaagtactatgcgatggtggattttgcaacctttgcgacaacgattgatacacttttccctgagggcgtaacgattgatgcacagttttcaactattaatggtgaagtcgttagctcagtagaagtgccgaatgatttacagctggaagaaaatgctcctgcttatcaaacgattcaggtcggtgtacagcagatggatggtaagaccttgcttaactacgcgcgctatcgttcggatgatgaaggtgattttggtcgtacgagacgtcaacaggaagtgctatctgctgttatgacacaggctaaaaatccaatgaaactattctctggctccgaagctataggtaaggttgtggccatgactccgacaacagtaccgcaaagctttatgtggctacagggaccaggccttctattggatgcggcaaatggtatcgaacgtgttacaatcccagaaaatggagactggattgacgactatgatatgtatggtggtatggctcttcgtgttgattttgaaaaataccagcagcgcttggctgagttaggcctgcgttaagaaatatggtatactagaagtgacttcggtcacttttttagtggtccaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcacaagaccgtaatcaggacttggattttacctatctaagaacaggtattgctgacttggggcatctcacttatccagcccaactagcttttaagaaaaaacaagttgagaatagtctacgtaagattgcaggcatttcagaaatagcagtagcagatacgttgggaatggacaatcctcttgcttatcgtaataaggcagctgttccagttcgtcgtgtgaatgggcagttagaaacaggattctttcgaaaaaattcacatgatttagttccgattgaggatttttacattcaacacaaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaagattttccgtgttgaaacccttattgagcgtttgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaagggctgtccttgatagtcagaagaatgctgctcgaaatgggattgataatgttacttatgtctgtgatagcgctgaatccgctatgcaaaaatgggtggcagatggagtcaaaccaactgtgatttttgtcgacccaccacgaaaaggtttgacagaaagttttatcaaagcaagtacttctgtaaaaccagagaaaatcgtctatatctcttgtaatgtggcaaccatggcgcgtgatattaaactttatgaggaattggggtacaaattgacgaaggtacagccggctgatttatttccaaatacgcatcacatagaagttgtgggattattagaaaaacgcaattagattgtccagtatgctctcctgttttttggcaagcagcttcaaagggccccaggacctttgaactctcaaatacgcatcatgttgacagttgccacacctacaccaaaatcaaatgccaacaagcgttgagtcgggtaatagcgtaagtagcgcaaggtcatgataagctgctcttccatacttagacggcgtgggcgtcctccttttcggtgttgctcttgataagcgtcagtgagacaatcaagcatcagatgaaacgtcgcttttttacacctatcaacaatttgaaattctctgagtttaattttaagactttttcgtatgttgtttccatacctttagtataccgcctttgagttaccgaacaagtctattgctaaacttgatgaaggttgtattgtctgttataatattggatattgcaagctttaagtgaaaggttttagggaagagattatcacaactcattctttattagttatgagacgatggtattaatgatagtctagtaaaagatttggagaaatgacttccttagaaagttaaatgtaaaaacaatatgaaaaaatacgattatctagttgtcggagcgggtctgttcggagcggtctttgctcatgaggcagctaaaaagggtaaaaaaataaaggttatcgaaaaacgagaccacattgcgggtaacatctatacaaaagaagtagaaggtattcaagtccatgaatatggcgcacatattttccatacttctgaaaaagaaatttgggattatgtgaatcagtttgcggagttcaacagctatacaaacacaccagtcgccaactacaaaggtgagatttacaatcttcccttcaacatgaatactttcaataaactgtggggcgtggtgacacctgctgaagcagaagcgaagattgcagagcaacgagctgtgttgggtggtaaaacgcctgaaaacttggaagagcaagccatctcacttgttggtacagacatctatgaaaaattgatcaagtcctacacagaaaaacaatgggaaaaaccatgtacggagttaccagccttcatcatccgtcgtttgcccgtgcgtttgacttatgataataactactttaacgatacttatcaaggtattccaatcggcggttacacgcagattgtagaaaaaatgttggaacatgaaaatatcgatgtggagacaaatgttgatttctttgccaataaggaagactatttagctacctatccaaagattgtctttacaggaatgattgacgagttctttgattaccaacttggtgaattggagtaccgtagccttcgatttgagacagaagtgttggatatggaaaactatcaagggaatgcggttgtcaactatacagatagcgagacaccatatactcgaatcatcgaacacaaacacttcgaatttggtacacaaccgaaaaccattattacacgtgagtattcgaagacctggaaacgaggcgatgagccatactatccagtcaacaataatcgcaataactatctatacacagcatataagaaattgtcagaacaacaagagaatgtcatattcggtgggcgtcttggtcattatcgttactacgatatgcaccaagtcatcggagctgccttacagtgtgtgagaaatgaagttggggaatgattttgagaagtcatcaaagtagtaattattcttggcagaagtcggaatgctcttaaaatgttaatcaaaaaaaccagaaattctggttttttttgattattattgaattgctgccaacaggtcagctacttgttgttcgagttttgttagagtttcgtcagataactccaatacacctgttccccatgcttctggattgatggttgaacctgtaaattcaccagcaatctgagtgcgaataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagtcaagagtgcttgagctttttttgccatttgatggttaaaagaaccgtcacgtagtgaaccaactaaaaacaatacgtttgccatgatggcctccttttcataaaaacataaatttagtatatcgtatttgtcttttgttgacaatcctaggtctgctgattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttctttataacgacagtcatgttgccagaagtgcttaataatttatcaattaagtcttgaatccgcagatttcctttgttgtagagtgcctccatcactccaaactgacaaactgtcagtccgtattttttgattgtttctaattctgattttgcgatagtattagctgctctgcgaaagacgactagactgtgaagtgcatgcttgttctcgtttaaagattgttcaacagttctcatgagaatattttagcaataaatcgttcggttatcaagcaaaaaaagttaaatcctatattcataggtaaagtacttttatggaaaagatagtttttagttaatcaagttcgttttttgaggtaatactaactgtactggaaaaaacgagcaatgagcatttgagaaatagtcttagatggaagtgcaaaactgtgaatgtaggtttttatatccttttctttgtgtgaaggaaaaggaaattttatttatagttaaatgaaacaaaaacagtacatttatgatataatg

SEQ ID NO: 34 - DNA, 45139 bp, Streptococcus suis
ggcaaaaaatagaagacagcaaaaaacggggcttttaatcccgttttgttttttccttgatccattgactgacgttggacagggttttgctttgctctgccttacgtttttgttcgtggacaaaatctgcaaagctttgcttgacgccgtccttttgaaccttgtcctgcaaatcatgccatttctttttaaggttgctggaagtccgttcgtaataaatctctaaaatttcttcttttgacttataattgcgatagaaagcgttgcgagaaactcccgcttttcggaccaattcagataccgaaatttgcttgagctcctttttctctaggagaaatagcagagcagtttctattgattccttagtcagttgatttgcttctttatttgattgatagaggtttttcaaagattggggtgaaattttacgacctgccatagttttccttttccgagtgtcacatctgaaagaaaatgctttcagacggggtagtttaatgatataattgtaagtaaatagagatttattgtcaaataaaaaagtaaaattggaaatgagaatattatgacaaaatggaaaattgttgcagattcgggctgcgactatcgtcaattagctaatctagctccggacactgaatttattagtgtgccacttaccatccaagttggagaacaagcatttgttgatgatgcaagcttagatattgatcacatgatggaggtgatggaagcatctaagtctgcagcggggtcggcgtgtccaagtccgcaggcttatcaggcagcttttgagggagctgagaatattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgtagacgaaatcaatcgcttaattagtgcaggattagattttccacaagtagtagaagcgataactcactatcgggaacacagtaagctcctctttgttttagcgaaagttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctacgaagtgaaagcgtgattcacagagtaataattttgggctgtaatttccgctatagaataatccccctcgttttctaagttcgaggggaattgtttgtatgagactattggatttcattcattcaaatatcttacgaattgctccagtttatctgcaaaatcttgttcaaagaagatctgtaagaaatcagctttctgtccgctgaaataataacattttccaaacatgtgttggatgctaggagaaagaatccccttgcttagctgaaaggtcacgctccctttggaaattcgatacgggatgtttaaagcgtatttctctagacagtcttttattttattccattgagcgtgataaatgtgatgaagatgctgtgtgttccgtgcaaacataccgttatcaatgtagagcgagagagctttttgcatgataagattggtatcgtagtcgattagactcttatgtttgatgaagatatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatctgctaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaattccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcttttagacaaatccgaaaatcttcatagggtaattcttgaaagtctgtaggattgagctctacagtatggtcttggaaatctctatcctctaagatataataaccgcttttttcgacagcgtagatcttattttggtattttaattccaacatagccttttggacagtgtctttgctacaatgatattgctcgcggagttgacggatagaaggtaatttctctccacgtttgaatcgatgttcctctattccagtcaaaatatcttggatgataacttgatattttttcatctaggtccccttttttatagactatgttactagctagtatatagaaaaaattgaagaaagacaatatatgaataatggggttgaggtttaggaattaagctactctatggtataattaagtgatgaaaataattatacctaatgcaaaagaagtaaatacaaatctagagaatgcctcgttttatctcctgtctgatcgaagcaagccggtgctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagccggtcagctaaaagttcactcgactatatcaaaaaaaggcagaggaagattgctgtcctggttggctaagaacaatattcaggaattatcggacattcaagattttaaggtggatggctttgaatattgtacttccgaatcaacggcaaaccaacttaccttcatacgatcaataaaaatgtgaaattatgaaaaagataacgttttccagcgctaaaaagggtagaaaaatattaatttctatgatataatggatgcgttataggtaaaagtctaggaaggttgtttatgaaaaagagaagcggacgaagtaagtcgtccaagttcgaattggtaaattttgcgcttttgggactttattccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcgctcttacttgttttttcactggtcatcacgtctgttgggatctatggactgcaagaagttgtaaaattttcaacacgactaaattcaaattcgacattttcagaatatgaaatgagcatccttgtcccagcaaatagtgatattacagacgttcgtcagcttactagtatccttgctccagccgaatacgaccaagataatatcaccgctttattggatgacatatccaaaatggaatctactcaactagcaactagccccgcgacctcttacctgacagcatatcaatctatgttgaatggcgagagtcaagcgatggtgttcaacggagtttttaccaatattctagaaaatgaagatccaggcttttcttcaaaagtgaaaaaaatatatagtttcaaagtgactcagactgttgaaacagctactaagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctggtatctacggtgtcaatgcttctgtgcacaccttagaaaatctctatgggattgacattagcaattatgtgcggctgaatttcacttccttccttcaattaatcgacttggtgggtggaattgatgtatataacgatcaagaatttacaagtttacatgggaattatcatttccctgttggacaagttcatttaaactcagaccaagcattaggcttcgttcgagagcgctactctttaacagggggtgacaatgaccgtggtaaaaaccaggaaaaagtgattgctgccttgattaaaaagatgagtacgccagagaatctaaaaaattaccaggcaatcctatctggattggaaggctcaattcaaacggatttgagcttagaaacgattatgagtttagtgaatacccaactagaatcaggaacacaatttacagtagagtcacaagcattgacaggaacaggacgctcagacttatcttcttatgcgatgcctggatcacaactttatatgatggaaattaaccaagatagtctggagcaagcaaaggcagcgattcagtccgtacttgtttaaaaataaagattttaggagaaaatatgaacaatcaagaagtaaatgcaatcgaaatcgatgttttattcttactaaaaacaatttggagaaagaaatttttaattctcttaactgcagtgttgactgcggggttggcatttgtctacagtagttttttagtgacacctcaatatgaatccactacccgtatctatgtagtgagtcaaaatgttgaagccggtgcgggcttgactaaccaagagttacaagcgggtacctatttggtaaaagactatcgggaaattatcctatcacaagatgtattgacacaagtagcaacggaattgaatctgaaagagagtttgaaagaaaaaatatcagtttctattcctgttgatactcgtatcgtttctatttctgtgcgtgatgcggatccaaatgaagcggcacgtattgcaaatagccttcgcacctttgcagcgcaaaaggttgctgaggtcaccaagggaagcgatgtgacgacacttgaagaagcagtcccagcggaagccccaaccactccaaatacaaaacgaaatatcttgcttggtttattagctggaggtatcttggcaacaggtcttgtactggttatggaggttttggatgaccgtgtaaaacgtcctcaggacatcgaagaggtaatgggattgatattgctaggtatagtaccagattcgaagaaattaaaataggagaacaatatggcaatgttagaaattgcacgtacaaaaagagagatagtaaataaaaccgaggagtatttcaatgctatccgtaccaatattcagcttagcggagcagatattaaggttgttggtattacctctgttcaatcgaatgaaggtaagagtacaactgcggctagtctcgctattgcctatgctcgttcggattataagaccgtcttggtggatgcagatatccgaaattcagtcatgcctggtttcttcaagccaattacaaagattacaggtttgacggattacctagcagggacaacagacttgtctcaaggattatgcgatacagatattccaaacttgaccgtaattgagtcaggaaaggtttctcccaaccctactgcccttttacaaagtaagaattttgaaaatctacttgcgactcttcgtcgctattatgattatgttatcgttgactgtccaccattaggactggtaattgatgcagctatcattgcacaaaaatgtgatgcgatggttgcagtagtagaagcaggcagtgttaagtgctcatctttgaaaaaagtaaaagagcagttggatcaaacaggcacaccgttcttaggcgttatcttgaacaaatatgatattgccactgagaagtatagtggatacggaaattacggcaaaaaagcctaatttctcagataacataagtttgataagtaggtattaatatgattgatatccattcgcatatcatatttggtgtggatgacggtcccaaaactattgaagagagcctgagtttgataggcgaagcttatcgtcaaggtgttcgctatatcgtagcgacgtctcatagacgaaaagggatgtttgaaacaccagaaaaaatcatcatgattaactttcttcaacttaaagaggcagtagcagaagtttatcctgaaatacgattgtgctatggtgctgaattgtattatagtaaagatatcttaagcaaacttaaaaaaaagaaagtacccacacttaatggctcgcgctatattctcttggagttcagtatgaatactccttggaaagagattcaagaagcagtgaacgaagtgacgctactagggctaactcccgtacttgcccatatagagcgttatgatgctctggcatttcagtcagagagagtagaagagctaattgacaagggatgctacactcaggtaaatagtacccatgtgttgaagcccgctttaattggcgaacgagcaaaagaatttaaaaaacgtactcgatattttttagagcaggatttagtacattgtgttgctagcgatatgcataatttatatagtagacctccgtttatgagggaggcgtatcagcttgtaaaaaaagagtatggggaggacagggctaaggctttgtttaagaaaaatcctctaatgattttgaaaaatcaagtacagtaacctcatagaaatagtggaggagatatgagtaatgaaataggatatcgccaaacgaaattggcattatttgatatgatagcagttgcaatttctgcaatcttaacaagtcatataccaaatgctgatttaaatcgttctggaatttttatcataatgatggttcattattttgcattttttatatctcgtatgccagttgaatttgagtatagaggtaatctgatagagtttgaaaaaacatttaactatagtataatatttgcaatttttcttacggcagtatcatttttgttggagaataatttcgcactttcaagacgtggtgccgtgtatttcacattaataaacttcgttttggtatacctatttaacgtaattattaagcagtttaaggatagctttctattttcgacaatctatcaaaaaaagacgattctaattacaacggctgaacgatgggaaaatatgcaagttttatttgaatcacataaacaaattcaaaaaaatcttgttgcattggtagttttaggtacagaaatagataaaattaatttatcattaccgctctattattctgttgaagaagctatagagttttcaacaagggaagtggtcgaccacgtctttataaatttaccaagtgagttttttgacgtaaagcaattcgtttcagattttgagttgttaggtattgatgtaagcgttgatattaattcattcggttttactgcgttgaagaacaaaaaaatccaactgctaggtgaccatagcattgtaactttttccacaaatttttataagcctagtcatatcatgatgaaacgacttttggatatactcggagcggtagtcgggttaattatttgtggtatagtttctattttgttagttccaattattcgtagagatggtggaccggctatttttgctcagaaacgagttggacagaatggacgcatatttacattctacaagtttcgatcgatgtatgttgatgctgaggagcgcaaaaaagacttgctcagccaaaaccagatgcaaggtggtatgtttaaaatggaaaacgatcctagaattactccaattggacatttcatacgaaaaacaagtttagacgagttaccacagttttataatgttttaattggcgatatgagtctagttggtacacgtccacctacagttgatgaatttgaaaaatatactcctggtcaaaagagacgattgagttttaaaccagggattacaggtctctggcaggttagtggtcgtagtaatatcacagacttcgacgacgtagttcggttggacttagcatacattgataattggactatctggtcagatattaaaattttattaaagacagtgaaagttgtattgttgagagagggaagtaagtaaaagtatatgaaagtttgtttggtcggttcttcagggggacatttgactcacttgtatttgttaaaaccgttttggaaggaagaagaacgtttttgggtaacatttgataaagaggatgcaagaagtcttttgaagaatgaaaaaatgtatccatgttactttccaacaaatcgcaatctcattaatttagtgaaaaatactttcttagctttcaaaattttacgtgatgagaaaccagatgttattatttcatctggtgcggccgttgctgtccccttcttttacatcggaaaactatttggagcaaagacgatttatattgaagtatttgatcgagttaataaatctacattaactggaaaactagtttatcccgtaacagatatttttattgttcagtgggaagaaatgaagaaggtatatcctaaatctattaacttggggagtattttttaatgatttttgtaacagtaggaactcatgaacaacagtttaatcgattgataaaagagattgatttattgaaaaaaaatggaagtataaccgacgaaatatttattcaaacaggatattctgactatattccagaatattgcaagtataaaaaatttctcagttacaaagaaatggaacaatatattaacaaatcagaagtagttatttgccacggaggccccgctacttttatgaattcattatccaaaggaaaaaaacaattattgttcctagacaaaaaaagtatggtgaacatgtaaatgatcatcaagtagagtttgtaagaagaattttacaagataataatattttatttatagaaaatatagatgatttgtttgaaaaaattattgaagtttctaagcaaactaactttacatcaaataataattttttttgtgaaagattaaaacaaatagttgaaaaatttaatgaggatcaagaaaatgaataataaaaaagatgcatatttgataatggcttatcataatttttctcagattttactggagagggatacagatattatcatcttctctcaggagaatgcacaccattagttccttcagaatacctgtataattattttaaatattctcaggatttatatgttgaatttacaaaagatgagcaaaaatataaagaaaataggatatatgaacgagttaaatgttacagattatttcctaatatatcagaaaaaactattgataatgtactgtttagaattttattaagaatgtatcgagcttttgaatactatttacaaagattgttgtttattgatagaataaaaaacatggtctaagaataagatttggttctaattgggtttcgcttccacatgattttgtggcaattcttttatcaaatgaaaacgaaacagcttatttatttaagtaatctaaatgtccagatgaactatttatacagacaattatagaaaaatatgaattttcaaatagattatctaaatatggaaatttaagatatataaagtggaaaaaatcaacatcttctcctattgtctttacagatgattctattgatgaattgctaaatgcaagaaatttaggttttttatttgctagaaagttaaaaatagaaaataaatctaaatttaaagaaattattactaaaaaataaaatagttgattttgtgagagtaatgtatgtttaaattatttaaatatgacccggaatattttatttttaagtacttctggttgattatttttattccagagcaaaagtatgtatttttattaatttttatgaatttaattttatttcatataaaatttttgaaaactaagctaatattaaaaaatgaaattttattgtttttattatggtctatattatgttttgtttcagtagtcacaagtatgtttgttgaaataaattttgaaagattatttgcagattttactgctcccataatttggattattgcaataatgtattataatttgtattcatttataaatattgattataaaaaattaaaaaatagtatcttttttagttttttagttttattaggtatatctgcattgtatattattcaaaatgggaaagatattgtatttttagacagacaccttataggactagactatcttataacaggcgtcaaaacaaggttggttggctttatgaactatcctacgttaaataccactacaattatagtttcaattccgttaatctttgcacttataaaaaataaaatgcaacaattttttttcttgtgtcttgcttttataccgatctatttaagtggatcgagaattggtagtttatcgctagcaatattaattatatgcttgttatggagatatataggtggaaaatttgcttggataaaaaagctaatagtaatatttgtaatactacttattattttaaatactgaattgctttaccatgaaattttggctgtttataattctagagaatcaagtaacgaagctagatttattatttatcaagaaagtattgataaagtattagaaaacaatattttatttggatatggaatatccgaatattcagttacgggaacttggctcggaagtcattcaggctatatatcatttttttataaatcaggaatagttgggttgattttactgatgttttcttttttttatgttataaaaaaaagttatggagttaatggggaaacagcactattttattttacatcattagccatatttttcatatatgaaacaatagatccgattattattatattagtactattcttttcttcaataggtatttggaataatataaattttaaaaaggatatggagacaaaaaatgaatgatttaatttcagttattgtaccaatttataatgtccaagattatcttgataaatgtattaacagtattattaaccaaacatatactaatttagaggttattctcgtaaatgatggaagtactgatgattctgagaaaatttgcttaaactatatgaagaacgatggaagaattaaatattacaagaaaattaatggcggtctagcagatgctcgaaatttcggactagaacatgcaacaggtaaatatattgcttttgtcgattctgatgactatatagaagttgcaatgttcgagagaatgcatgataatataactgagtataatgccgatatagcagagatagatttttgtttagtagacgaaaacgggtatacaaagaaaaaaagaaatagtaattttcatgtcttaacgagagaagagactgtaaaagaatttttgtcaggatctaatatagaaaataatgtttggtgcaagctttattcacgagatattataaaagatataaaattccaaattaataatagaagtattggtgaggatttgctttttaatttggaggtcttgaacaatgtaacacgtgtagtagttgatactagagaatattattataattatgtcattcgtaacagttcgcttattaatcagaaattctctataaataatattgatttagtcacaagattggagaattacccctttaagttaaaaagagagtttagtcattattttgatgcaaaagttattaaagagaaggttaaatgtttaaacaaaatgtattcaacagattgtttggataatgagttcttgccaatattagagtcttatcgaaaagaaatacgtagatatccatttattaaagcgaaaagatatttatcaagaaagcatttagttacgttgtatttgatgaaattttcgcctaaactatatgtaatgttatataagaaatttcaaaagcagtagaggtaaaaatggataaaattagtgttattgttccagtttataatgtagataaatatttaagtagttgtatagaaagcattattaatcaaaattataaaaatatagaaatattattgatagatgatggctctgtagatgattctgctaaaatatgcaaggaatatgcagaaaaagataaaagagtaaaaatttttttcactaatcatagtggagtatcaaatgctagaaatcatggaataaagcggagtacagctgaatatattatgtttgttgactctgatgatgttgttgatagtagattagtagaaaaattatattttaatattataaaaagtagaagtgatttatctggttgtttgtacgctactttttcagaaaatataaataattttgaagtgaataatccaaatattgattttgaagcaattaataccgtgcaggacatgggagaaaaaaattttatgaatttgtatataaataatattttttctactcctgtttgtaaactatataagaaaagatacataacagatctttttcaagagaatcaatggttaggagaagatttactttttaatctgcattatttaaagaatatagatagagttagttatttgactgaacatctttatttttataggagaggtatactaagtacagtaaattcttttaaagaaggtgtgtttttgcaattggaaaatttgcaaaaacaagtgatagtattgtttaagcaaatatatggtgaggattttgacgtatcaattgttaaagatactatacgttggcaagtattttattatagcttactaatgtttaaatacggaaaacagtctatttttgacaaatttttaatttttagaaatctttataaaaaatattattttaacttgttaaaagtatctaacaaaaattctttgtctaaaaatttttgtataagaattgtttcgaacaaagtttttaaaaaaatattatggttataataggaagatatcatggatactattagtaaaatttctataattgtacctatatataatgtagaaaaatatttatctaaatgtatagatagcattgtaaatcagacctacaaacatatagagattcttctggtgaatgacggtagtacggataattcggaagaaatttgtttagcatatgcgaagaaagatagtcgcattcgttattttaaaaaagagaacggcgggctatcagatgcccgtaattatggcataagtcgcgccaagggtgactacttagcttttatagactcagatgattttattcattcggagttcatccaacgtttacacgaagcaattgagagagagaatgcccttgtggcagttgctggttatgatagggtagatgcttcggggcatttcttaacagcagagccgcttcctacaaatcaggctgttctgagcggcaggaatgtttgtaaaaagctgctagaggcggatggtcatcgctttgtggtggcctgtaataaactctataaaaaagaactatttgaagattttcgatttgaaaagggtaagattcatgaagatgaatacttcacttatcgcttgctctatgagttagaaaaagttgcaatagttaaggagtgcttgtactattatgttgaccgagaaaatagtatcacaacttctagcatgactgaccatcgcttccattgcctactggaatttcaaaatgaacgaatggacttctatgaaagtagaggagataaagagctcttactagagtgttatcgttcatttttagcctttgctgttttgtttttaggcaaatataatcattggttgagcaaacagcaaaagaagcttctccaaacgctatttagaattgtatataaacaattgaagcaaaataagcgacttgctttactaatgaatgcttattatttggtagggtgtcttcatcttaattttagtgtctttctgaaaacggggaaagataaaattcaagaaagattgagaagaagtgaaagtagtactcggtaagaatgttgtaataaatggttgaaagaaaaggggattaaaatgaatccaacaaatagtagaatagcactctttgatacgattaaatgtatcatggtactttgtgttatttttacacatctggattggtctgttgagcagcgtcaatggtttatctttccgtatttcgttgacatggctgttccaatttttctgttgctttctgcctattttcgaacgaataagtggaatacaaaacaagagacgctaaagctcaagttcagcagtggtataaaagaaagtataaacatgctttgtctctatgctatcgtgatggctgttaatgttttattgagctattcgagaaccatctgataggagtaaagcctttttcaggttcttcatcgctccgttcatttgtcctgtggctactttctggagaatcgggtccagggagttgggagttactatgttccgttgttgattcaggtagtttttttattaccaattttgtatgttcttttcgagaaaaataaatggttgggcttgcttacttgttttttagtaaacttttcagtggatgccatatttgctaacatggctgaacacggcatatatatatagactaatatcacttcgttatctttttgttctagggcttggttttttctttcaaagcaggatgtgcgttccaaggtagatactttcattgcgaccctatttgggattattggagcaattctgatttttgtgaatcattctatagagcccttctcctggttttatggttggaagtctacttcctttctatgcgtcccatttgcgtatgctatgctattttttatgataaagtatggacagaagattccagcaacactgttgtcaaaattgggagttgcttcttatcatatctacttgacccagatgctgtatttttcagtagtcgcaccatttttagcagtgcaatttaaggtatcttcgttgaatttgtggaacggcttgtttacctttctaatttgcctgtttggtggctatattttctacaaagtggatctgtttatgagagtacgtggaaaacgataatgactcatttcagattagcagatgccatttcgtttattagcagattcgcatgttaatattccgacaaagaaattcaaataggttgacgagagaggagtggtatctgtttctaaaccccagtatccccctttattttcaaagctatatttattaactgaacaaggagaatttttaagagaactgtttgtttaatcccagcacgatctggttcgaaaggcttaccgaataaaaacatgctatttttggacgggaaacccatgatttttcacacgattgatgtggcaattgaatcaggttgttttgagaaagaagacatctatgtcagtacggattcagaaatgtataaggggggcacctctataaattcccaaaattgcgaatttggagttacgaaagccttgttaaatcaacatcttaaattttagaaaattagtttttagaggtccccaaggggatttgcgagacaagaggcatcaatgtattgttaagacccaaagaactatctacttatcatactccatcgaatgaagtcagtacgcacttttttacgaatctggattttatgaagattgtatatttgttcttctgcaagtcacctcaccgttacggactggcgaacagataaaagaagccatgaatatgtacttacagggggactcagaaaatgttttgcatttcaatgatgaagggcaagaaagagtgaatcagtacattatcgaagctgtacaggggttataaaaaggggttacttatccttaaagtctgtatgtagaaggagaaaaattgagacgaatttatatttgccatacgatgtatcagatcctgatttccttgttaaagatggacgttgagagagatagtttgatgtccgttgatatcatcgggcattttccagatgtcagggagcaactgcagcagcatgttcatctaatcgaggagacggagcgttcatttgatctatattctttgatagctagatcaaaaacaaaagaacgcctttccttgttacagagctatgacgaggtgatcatttttcaagatcaccgtcaagtcggtcattttttaaataaacatcggattccctattctcttttggaggatggttataattttttcaaggataaaagagtgtgcgatttggagtcaattcaatcatctgtctggaaaagactcttttatcaatggtattttaaaccaacatatttgattggttcaagtctctattgtcaatccattgaggtcaatgatctgtcgctcgtacaatttgacgaggcttataaaccctttgtagaagttccgagaaagcaattatttgatcaagcatcgccagagaaggtgcaagcgctgctgcagatatttggagcaagggcgatagtagcggatgaagagtcttctcaaaaacgattgctattattgacccagcccttgtcttgggattatcatgtgaccgaagaggagttgttggagatttatgtagcaggtcttgccccttatcgggaagactatacaatctacataaaaccgcacccacgagatggggttgattattcatttctgggtaaggctgtggtgcttctgcctcaaggtattccgtttgagttgttcgaaatggcaggtagtatccgttttgatatcggtatgacctatagttcgtctgctttagattttttaaattgttttgaagagaaagtgtatttaaaggacacttttcctcttctttcaaaaaatgatattttgcgtgaggggatagaataggaggattcatgtctaaaaaatcaatagttgtctcaggtctcgtctatacgattggaaccatcctcgttcagggattagccttcattaccctccccatctatactcgtgtcatttctcaggaagtatatgggcagtttagcttgtataattcgtgggtggggctagttggtctctttatcggtctacagttaggtggggcttttggcccgggatgggtacacttccgcgagaaatttgatgatttcgtatccaccttgatggtctcttctatcgctttctttttaccaatttttgggctatcttttctcctcagtcagcccctatcgctcctatttggtttgcctgattgggtcgttccgcttatctttttgcaaagttttatgagtgttgtgcaaggattttttacgacctatttagtgcagcggcagcagtccatgtggactttactcctatcggtactgagcgctgttatcaacactgctttatctttatttctcatcttttcgatggagaatgatttcatcgctcgtgtaatggcaaactcggcaacgactggtgtttttgcttgtgtgtccttgttgtttttctataagaagattgggcttcattttcgaaaggactatcttcggtatggtttaagtatatcgattcctcttatttttcatggattaggtcataatgtactcaatcaatttgacagaatcatgctcggcaagatgctaacactgtcagatgtagccctatacagtttcggctacacacttgcgtctatcttacaaattgtgttttcgagcttgaatacggtatggtgtccgtggtattttgagaaaaagagaggtgcagataaagatttgctcagttatgtccgttactatctggcgattggcctgtttgtgacttttggatttctaacaatttaccctgaattagtgatgttgttaggtggatctgagtatcgtttcagtatgggatttattcccatgattattgtcggggtgttctttgtatttctttatagttttccagccaatatccagttttatagtggaaatacaaagtttttgccaattggtacttttatagcaggtgtactaaatatttcagtcaactttgttttgataccgacgataggaatttatggtgctgctttggcaacgactgcttcctatctgttgttgctagtcttgcattattttgttgctaagaaaaagtatgcttacgatgaagttgcgatttcaacatttgttaaggtaattgctcttgttgtcgtctatacaggcttgatgacagtatttgtcggttcaatctggattcgttggtcactaggaatagcggttctagtcgtttatgcctacatttttagaaaggaattaacagttgccctcaatacattcagggaaaaacggtctaaataagggcacctctataaactcccaaaattgcgaatttggagttacgaaagccttgttaaatcaaacattttaaattttagaaaattagtttttagaggtccccatataaaaacgtcccaaatgagaggtgctcataagaattgaccatcactgccatctacccaaagttcaagtattctctaccatgaaaattgtgctataatcaagtataaagaagggaatgtttcttaaaggacgtatgcgcctctgcttatgccagaagtcatgaggtaaatctccctaaaaattgggtagaaaagcagattaaacttccaccaatctattgaagatcgtgtgaagaagcaggctttagaagcaacaagccctgagactattcgaaagaaatctagggctattttttctaatcggctatcagaagtgaagtagcgatctttattagtgttcttttactacttaaggaaaaccaagctgctccctcaagactttatgggagcgatttacagtcatttttagaaaggaaataaaatggtttatattattgcagaaattggttgtaatcacaacggtgatgttcatctagcacggaaaatggtagaagttgccgttgattgtggtgtggatgccgttaaatttcagacatttaaggcagatttgttgatttcaaaatacgcaccaaaggcagaataccaaaaaattacaacaggagagtcagattctcagctcgaaatgactcgtcgtttggaattgagctttgaagagtatcttgatttgcgtgattactgtcttgaaaagggagttgatgtgttttcgacaccttttgatgaggaatcattggacttcttgattagcacagatatgcccgtttataagattccatctggtgagattaccaatcttccctatttggaaaaaattggtcgtcaagctaagaaagttattctttcaactggtatggctgttatggatgaaattcatcaagcggtgaagattttgcaggaaaatggaacgaccgatatttcgattttgcattgtacaaccgagtatccaaccccttaccctgctttgaatttgaatgtcttgcataccttgaaaaaagaatttccaaacttaacaattggctattcagaccatagtgttggttcagaagtacccatcgctgctgcagcaatgggagctgaattgattgaaaagcactttactctggacaatgaaatggaaggaccagatcataaagcgagtgctactcctgatatcttagcagccttggtaaaaggagtgaggatagtggaacaatctcttggtaaatttgaaaaagagccagaagaagttgaagtacgaaataaaattgtagctagaaaatctattgttgccaaaaaagcaattgctaaaggcgaagtctttacagaagaaaacatcactgtcaaaagaccaggaaatggaatttcgccaatggaatggtacaaagtcttggggcaggtgagtgagcaggattttgaggaagaccaaaatatttgccatagtgcttttgaaaatcaaatgtaagcggagtaaggatgaaaaaaatttgttttgtgacaggctctcgtgccgaatatgggattatgcgtcgcttattgagctatctacaggatgatccagaaatggagctggatcttgtagtgacagccatgcatctagaagaaaaatatgggatgacggtcaaagacatcgaagcggacaagcgtaggattgtcaagcggattccattgcatttgacggatacgtctaagcagacaatcgtcaaatctttagcgaccttgacagagcaactcacggttctttttgaagaagtccagtatgacttggtgttgattctgggggatcgctatgagatgctaccagttgccaatgctgcgttgctttataatattcctatttgccatattcatggtggtgaaaaaaccatgggaaattttgatgagtcgattcgccatgccattaccaagatgagtcaccttcatctgacatcaacggatgaatttagaaatcgtgtcattcaactaggagaaaatcccaaccatgtactgaacatcggagctatgggtgttgaaaatgttttaaaacaagactttttgacaagagaagagttggcgatggaacttggaattgattttgccgaggattactatgttgtactctttcaccctgttaccttggaggataacacagccgaagaacaaacgcaggccttattagatgctctaaaagaagatggtagccagtgtttgataattggatccaattcggatacacatgccgataagataatggaattgatgcatgaatttgtaaaacaagactctgattattacatctttacttcgcttccaactcgttattaccattccttggtcaagcattcacaaggtttaatagggaattcttcgtcaggtttgattgaagtgccctcattacaggttccgaccttaaatattggaaatcgccaatttggacgtttgtcaggaccgagtgtggtacatgttggaacttctaaggaagcgattgttggtggtttggggcaattacgtgatgtaatagattttaccaatccatttgaacaacctgattctgctttacaaggttatcgagctatcaaggaatttttatctgtacaggcctcaaccatgaaagagttttatgatagataggggagaaagtttgatgaaaaaagtagcctttctaggagcgggtaccttttcagatggtgtccttccttggttggatagaagtcgatatgaactcattggatattttgaagataaaccgatcagtgactatcgtggctatcctgtatttggtcccttgcaagatgtcctaacctatttggatgatggaaaagtagatgctgtcttcgtcactataggtgacaatgtcaagcgcaaggaaatctttgacttgcttgccaaagatcattatgatgctttgttcaacatcattagcgagcaagccaatattttttccccagatagtatcaagggacgaggggttttcataggtttttcaagttttgtaggagccgattcctatgtctatgacaattgtatcatcaatacaggtgccattgtggaacatcataccacggtggaggcccattgtaacattactccaggagtgaccataaatggcttgtgccgtatcggagaaggcacttatattggaagtggttcaacagtgattcaatgtatcgagattgcaccttatacaacattgggggcagggacagttgttttgaaatcgttgacggagtcagggacctatgttggtgtacctgctagaaagattaaataggtgaattgatggaaccaatttgtctgattcctgctcggtcaggatcaaaaggtttaccaaataaaaacatgttatttttagatggtgtaccgatgattttccataccattcgagctgcgattgagtctggatgttttaagaaagaaaatatatatgtcagtactgattcagaggtttacaaggaaatttgtgaaacaactggggttcaagtcctcatgcgtccagctgacttggcgacagattttacaacctcttttcaactgaacgaacattttttacaagatttttctgatgaccaagtatttgttctcctgcaagttacgtccccattaagatcgggaaaacatgtcaaggaggcgatggagttatatgggaaaggtcaagctgaccacgttgttagctttaccaaagtcgataagtctccaacattgttttcaactttagacgaaaacggattcgctaaggatattgcaggattaggtggcagttatcgtcgtcaagatgagaaaacactctactatcctaatggagcgatttatatttcttctaagcaggcttatttagcggataaaacttatttttctgaaaaaacagcggcctatgtgatgacgaaggaagattcgattgatgtagatgatcactttgattttactggtgttattggtcgaatttactttgattaccagcgtcgtgagcaacaaaacaaaccattttataaaagagagttaaagcgtttatgtgagcaacgagtccatgatagtcttgtgattggcgatagtcgtctgttagccttgttactggatggtttcgataatatcagcatcggtgggatgacagcttcgacagcacttgaaaaccaaggtctctttttggctactccgataaagaaagttttgctttctcttggtgtgaatgatttgattactgactatcccttgcatatgattgaggatactattcgccagctgatggaaagtcttgtttccaaagcagagcaggtttttgtgacgacgattgcctacacgctgtttcgtgatagcgtttcaaatgaagaaattgtgcagctgaatgacgttattgttcagtcagcaagtgaactgggtatttcagtgattgatctaaatgaagttgttgaaaaagaggcgatgcttgactatcagtataccaatgatggattgcatttcaatcagattggacaagagcgtgtgaatcagctgattttgacaagtttgacaagataatttggtgatagaagctatttcagtggctagactatgttggtatgtgttttagagccaaggaataacatctgtagaggatgctagtcttgagaattgacaaccatttagttgtttaattatataaggggacctctaaaaactccctaaatttcccaaaaatgagataatagaataaaaagtaatgaggagagctgtcatgcatttattcacagacgatgaaaaaatcttgtcaaaactatcagagaaaggcaatcccttagaacgtttggatgccgttatggattggaatatctttcttccattgttgtcagagttattcagtcgtaaagataaagtcatcagtcgtggcggtcgtcctcacctagactatctcatgatgttcaaagcgctcttgcttcaacgtcttcataacctatctgacgatgccatggaatatcaactgctggatcgtatatcttttcgtcgttttgttggttgtcatgaagacactgttcccgatgcgaaaactatctggctctatcgtgagaaattaaccaagtcaggtcgtgaaaaggagttgttcgatttgttctatgcccatctcacagatgaaggggtgattgcccattcaggtcagattgtggatgctacctttgtcgaatgccctaaacaacgcaattcacgtgaggacaatcagaaaatcaaaacttatcgaaaattatgaggtcacaacagctagtgtacacgactccaatgtcctagctcctctttgtgatgccaatgaagcggtttttgatgacagtgcttatgttggaaaatcagtaccagaaggttgtcgccaccacacgattcgtcgtgcttttagaaataaaccgttgactgagactgataaggtcattaatcgacatattaccaaagtccgttgtcgcgttgagcatggttttggcttcattgaaactaacatgaaaggtaacatctgtcgagcaattgggaaggcacgagctaaaaccaatgtgaccttaaccaacctgctctacaatatctgtcgttttgagcaaatcaaacgactgggattaccatcgtgggcttagtgcgcccaaaaataggaaaataagcaaaaagaggctgggcaaaaactagtttctcacaataaaaaaacggctctttgtcaactgtagtgggtagacgaaaagctaacacctagagaggacgaaattcgttctctcatttttgatgtttaaagcgtaaccgcctaataacaaggtatctatccaatcacacattcctccattatactgttataaaaaacaaactggaggattcattatgtcacagcccgtcgtcccattgactattccccaatctcgccgctttgaaaagaaaagcagaaacgatattctgatgaaaattcgtctcggaaaaacggaagtcacattcttccaatctatcaaccctgaagtaatggaaacaatcttggataaggtgctgcattatgaccatccgactcagtgatttaggtcaagtcttcttggtctgtgggaaaacggatatgcgtcaggggattgactctctcgcctatcttgtcaaaagtcaatttaatctggatcccttttcaggtcaggtctatctcttctgcggaggtcgaaaagaccgattcaaagctctttactgggatgaacagggattttggttattgtataaacgttttgaaaatgggaaattggcctggtcaaacaatgaagaagaagtcaaggctctaacttccgaacaagtagattagctcatgaaaggattttctatcattccaaaaataaatgtttcaaaaagtcgtgatttctattgaaatcatggcttttctttgtgtataatgagataaaaagaaggaggagcgagcgtatggatgagttgttggcaattattaaacaacagacctcaacgattgaacaacttaccaatgagctaaccctccttcgagaacaggttgactatctgagacagaaactctacggaaaatcatcagagaaagttgtgtatcaacccggtcagctgagcttgtttggggaggaaagcctccctgaagaagaagctgacttacccagttgaaacagagatcatcactataaacgcaagaaaactaagggagttcgtcaggctatttttagtcaattcactccagagatagtgcatcacgaattgcagggcgaagactgcacttgtccagactgtcatggtcagttgaaagagattggctcagctgttcaacgacaagagttggtcttcattcctgcacaattaaagcggattgaccatgttcaacacgcatacaagtatcaggcatgtagccagaagaatctgagcgataagattatcaaggctcccgttcctaaggcacctttggcacacagcttgggttcagcctctatcatcgctcacaccattcatcagaagttcaatttgaaggtgccaaattaccgtcaggaagaggattggcataagcttggcctgcccatcagtcggaaggaaatagccaactggcatatcaagtctagtcagtattatttcgagccgatttacaacctgttgcacgagaaattgttggagcagcctattctccatgcggatgagaccgcctacaatgtcttagaaaatgatggtcagttgaccttcttgtctgggaaacatgaggaaaatggaattaccctctatcatcatgacaaacgacggagtggcttggttgtggaggaggttcttggggactatgcgggctacgtacattgtgacatgtggagtgcttatcgtcaattagacaaggctcagctggttggttgttgggctcccgtcaaacgaaagttctttgaggcgactcttaagaagacagacaagacttctttaggagcccaagggcttagcctattgcgaccgcctgtttgccttggagagttgactgggctgacttgtctagcgaggagcgactgcataaacgctggctcccttgatggacgagttctttgactggtgtcgtgagcaatctgttttgccaggctccaaattgggtactgctttggagtatagcctcaaatacgaaaccaccttccgaaccgttctctcggatggtgacttggtcctgtctaacaacatggctgaaagggctatgaagaccttggtgatgggcagaaaaaattggttgttctcccaaagttttgagggagccaagtcgacagctatcattttgagtcttttggaaacggccaagaggcacgaacttgatacagagaaatatatgacctatcttctagacaatctacctaacgaggaaacactcgctaaaaaagaagttctagaggcttatttgccatgggagaagaaaattaagagagcatgtaaatagaaaaaggttccagagtcaataggactttggagccttttcaatataccttattattgggcggttacaaagtagcctaggaaacgaagccgaagatagaactggagttggagttcatcaaggcaagttgacaacggataattttgattttcgaagagtatcaataaaaatcaaagatagcaagtctaagctacttatgaaagttctataatgaagtcaaacgtgggacaactttacaacaagtgcgaaaagggctgtacaaaaaagtctattctgctgactatgcacaaacggtataccgaactaatcgaaaacgatcggtaaaaaagataatcctaacgaaagaattgaaagagaaaattttacactatactaagcaaaaattttttcctgaaatgatggttaagaagaagaaaatgaaagtgggtatttcaaccatttactattggtttcatcatggccatttaggattgacgaaagcagatatgctttaccctagaaaagggaaaagggtcaagaagcaagctagtcctaactttaaaccagcaggaaaatctatcgaagaacgtcctgacgttattaatcttcgcttggaaaacggtcattatgaaattgatacagttctactaaccagagggaaaaatcattgcctcttagtcttaaccgaccgacgaagcaggcaccaaatcatacgattaattccaaacaaaaccgccgaatcggtcaatcaggcactggagggaatcttgagggaacatcgtatcctgtctataactgtagataatggtacagaatttagtcgtctggctgaagtgtttcctgaggagtatatctactatgcgcatccctattcttcatgggagaggggaacgaatgaaaatcacaatcgattgattcggagatggttacctaaaggaaccaagaaaacgactccaaaagaagtcgcttttatcgaacattggatcaacaactaccctaaaaaatgcttggactacaagtcgccgagtgaatttcttatgggtggctaatttcaacttgaaatttggggtctaagctacttataacatttgaaaccttaatttataagtttgagttgaggattgtggatttcaagcagctgttttcttctaaaaaaataacaaaatcgaaacggtccatatccactttgagtggtagttggctatttttgattttaaatgagtatcacaccccatcgtcccattgactgttccccaatctcgccgctttgagaagaaaggcagaaatgatattctgatgaaaattcgtctcggaaaagtggaagtcacattctttcactctatcaaccaagaaacattagaaacaatcttagataagatactattttatgaccatccgactcagtgatttaggtcaagtctacttggtttgcgggaagtagtggtgtgatttggttaagaggattatgctcacttagaatttctacctgcttgctttgagagacatgagtgtagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagacttaagcgcacactttgttctttaagatgatcatcgtttttcacactggtaaatagataactagaatgactacaatgactacaatgatgcgctatatagtcttcaagtaacgaaagtgttttatcgtttccaatatagagtagtcgcactttctttccttttccgagtatttgaatggttctattttccaaattgatattatcaagttttaaattacataattcagagatgcgtagaccagttgataaaagtagcgagataaggagtagatttcgcatagctttccgcttagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagtcttttttatatgttggttgagaaaagtaagataggacctaatatcattggccctaaagctataatactaatgtaaattggatttgtatgcttggatagtatgagaactaagtcgtctttgaatagcacaaaagtcaagatatctctggatagtgtcgtaattcataatataatctccttaatatgtcgtaataaagctattatatacgataatttatcaatttactaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctggtcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgctgattccctctttttgcgattactttagcattaattatacaggttcaaatgcactaacagtttcattatgtcgtaatatagtcaactgaaacaagagcaggacgaaagtgcctcaagaaaagtatcgcaatttggcaatactcttctgaggtgttttttgatgtgagcccatattttctcaatgggattatattccggtgagtaaggaggaagtggtaaaagtctatgtccctgctcctcgcataaatcttttagcttactcatcctatgaaactttgcattgtccataatgataacagatggtttacctaaagtgggtagtaagaatgttttgaaccaagcttcgaaaaagccactcgtcatagtatctttgtatgtcatcggggctataagcgcaccatttatgagacctgctactaaagatatccgctggtatcttcttccagagaccttaccttttatcaactgacctttcaaagagcgaccatattttcgatgaaaatatgtctcaaaccctgtctcgtcaatataaacaggagtcaagtggcttaagttattcaattctttaaggaacagttctactttttcagggtcttgttcatagtaggtacagctcttttttttcgagtatatcccatagctttgagggcgtaatgaatagctgttggatgacagtcaaattcagaagctatttcagtcaaataagcatctggatgagtttcaagataattctttaatttatctctatccacttttcttggcttggttcctttaacttggtgatgaagctcgccggttttctcttttaattttagccattgatagatagtgttacgtgaaacttggaaaatagctgatgcttcagtaatactgccggttttctcacagtatgcgagaacttttttacgaaaatctaatgaatatgccataaatacattatatcataaatgtactgtttttgtttcatttaactataaatttatttggggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtcccttttttaatattaaagggaaatatcttgtattagatccagtcaaaattgtctcttcttcagaaattataacaagcaaactatctgataataatagttattcatttgaatggttggaagatcaacaaatatgtacaaaattaaaagagtcaacaaaaaaaactcgccaagtacttaggtataaccacttacggacgagttgattttagaataaagtcagatgggagttattttgtttttgatattgcaacaatgccttacacatctgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcgcctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctattaaatgaggtaatagcatgtaaatacatgaaagatagtgaataggctcaacaataacatctttggcgctttcagctaatatattttagcaaagtgtatcacaaagtgaatgaaaagaaaaatcttgtgatgtatttccttgaaagttaatatcattctttaataatatcgaagataataatgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattacctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaagaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattccaatgagacataattaaactttcctaccgataacaatttattatcattagtataccataatctacatttgttttatagattttattaaaatttttatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaagaagcgtagaaaaactaaagggaacgattcgtgtcccaggtgataaatcaatcagtcatcgttctattatttttggttcccttgcaaaaggtgttacccgtttccacgatattttacgtggggaagatgtcttgtcaaccatgcaggtctttcgtgatttgggtgtaaaaattgaagacaatggtgatattgttgaagtacacggtgttggctttgatggtcttcaagcccccaaaaatgatttggatatgggaaattctggaacctcgattcgtttgatttcaggcgttttagcaggtcaagactttgaggcgactatgtttggtgatgattccttatccaaacgtcctatggaccgagtaactattccactcagtcaaatgggagtagagatttctggacaaactgaacgtgacctacctccgttgaccatcaaagggaataagaatttaaaaccaattcgctaccaactccctgtagcctctgctcaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcataccaggttcaaaaattgtccttgaaaatgtgggaatcaatgaaactcggactggtattttagatgtcattaaagctatgggtggtaaaatgactctttctaacatagatgaacttgcaaaatctgctaccattacagttgaaacgtcggaattgaaggctacggagattgcaggcgaattgattcctcggttgattgatgagttgccgattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaagaattgctggacttacctagtaattgtatcgtatcaactggtggtggtgtgattaaatctgaagtaaacagggaattgctgttggcaaatagggagggcaatgtacttcttactgcctcctttgaagtttcctatcagagaattcgtaaggatagacagtcgcaaagacctctctttttacagtgtagtaaggaagagtttgaagccctctatcgtgaacgaatggcactttatcaaggtttagccgatactgtaatcgatacagataaactgattccagaacaagtagtaaggaaaattttatgcaagtagcctatctaggacctcgtggttcttttacacatcaagtggcccagcaggtctttccgactgcggatttgcaggcttttgagacgattacagaggttatcaaggcctacgaaacgggggaagttacctattccgttattccagtagaaaactcgattgaaggtagtgttcatgaaacgattgactacctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagttagtacagcctatgctgctcgctttgtggcagaacaccctgaacaaccatttgcggcaattgctccgcaagcggcagcagttgaatatggactggaagtaattgcgcaagacatccaggaaatcagcgagaattttacacgcttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccgacccctgaaaacggctttgggtgagtattttttcatactggatcttgacaatcagtctgaggaattattaacctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggattatctattatataaaaaagagctgagagaacggcatggaagtccaaggcaatctctacgtagcttcacaccaacggcttatgaagatgactacttcgaggaagattattttgaagaggatgatgagcaagaggaactgttgcctcgctatcctgaacgtaaatccagaaaaacaagacaagccaaacctcaacggtttcagtctcctcgtatcagtcccaaagcgaaagtacctaaacctaaaaaagctcgtaaaaagggtggtttcaagcgctttattggtttcgtattgcttgctatagcgctagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggcgaaagctcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaatagttttgacattgatatcaagtactatgcgatggtggattttgcaacctttgcgacaacgattgatacacttttccctgagggcgtaacgattgatgcacagttttcaactattaatggtgaagtcgttagctcagtagaagtgccgaatgatttacagctggaagaaaatgctcctgcttatcaaacgattcaggtcggtgtacagcagatggatggtacgaccttgcttaactacgcgcgctatcgttcggatgatgaaggtgattttggtcgtacgagacgtcaacaggaagtgctatctgctgttatgacacaggctaaaaatccaatgaaactattctctggctccgaagctataggtaaggttgtggccatgactccgacaacagtaccgcaaagctttatgtggctacagggaccaggccttctattggatgcggcaaatggtatcgaacgtgttacaatcccagaaaatggagactggattgacgactatgatatgtatggtggtatggctcttcgtgttgattttgaaaaataccagcagcgcttggctgagttaggcctgcgttaagaaatatggtatactagaagtgacttcggtcacttttttagtggtccaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcacaagaccgtaatcaggacttggattttacctatctaagaacaggtattgctgacttggggcatctcacttatccagcccaactagcttttaagaaaaaacaagttgagaatagtctacgtaagattgcaggcatttcagaaatagcagtagcagatacgttgggaatggacagtcctcttgcttatcgtaataaggcagctgttccagttcgtcgtgtgaatgggcagttagaaacaggattcttccgaaaaaattcacatgatttagttccgattgaggatttttacattcaatacaaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaagattttccgtgttgaaacccttattgagcgtttgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaaaggctgtccttgatagtcagaagaatgctgctcgaaatgggattgataatgttacttatgtctgtgatagcgctgaatccgctatgcaaaaatgggtggcagatggagtcaaaccaactgtgatttttgtcgacccaccacgaaaaggtttgacagaaagttttatcaaagcaagtacttctgtaaaaccagagaaaatcgtctatatctcttgtaatgtggcaaccatggcgcgtgatattaaactttatgaggaattggggtacaaattgacgaaggtacagccggctgatttatttccaaatacgcatcacatagaagttgtgggattattagaaaaacgcaattagattgtccagtatgctctcctgttttttggcaagcagcttcaaagggccccaggacctttgaactctcaaatacgcatcatgttgacagttgccacacctacaccaaaatcaaatgccaacaagcgttgagtcgggtaatagcgtaagtagcgcaaggtcatgataagctgctcttccatacttagacggcgtgggcgtcctccttttcggtgttgctcttgataagcgtcagtgagacaatcaagcatcagatgaaacgtcgcttttttacacctatcaacaatttgaaattctctgagtttaattttaagactttttcgtatgttgtttccatacctttagtataccgcctttgagttaccgaacaagtctattgctaaacttgatgaaggttgtattgtctgttataatattggatattgcaagctttaagtgaaaggttttagggaagagattatcacaactcattctttattagttatgagacgatggtattaatgatagtctagtaaaagatttggagaaatgacttccttagaaagttaaatgtaaaaacaatatgaaaaaatacgattatctagttgtcggagcgggtctgttcggagcggtctttgctcatgaggcagctaaaaagggtaaaaaaataaaggttatcgaaaaacgagaccacattgcgggtaacatctatacaaaagaagtagaaggtattcaagtccatgaatatggcgcacatattttccatacttctaaaaaagaaatttgggattatgtgaatcagtttgcggagttcaacagctatacaaacacaccagtcgccaactacaaaggtgagatttacaatcttcccttcaacatgaatactttcaataaactgtggggcgtggtgacacctgctgaagcagaagcgaagattgcagagcaacgagctgtgttgggtggtaaaacgcctgaaaacttggaagagcaagccatctcacttgttggtacagacatctatgaaaaattgatcaagtcctacacagaaaaacaatgggaaaaaccatgtacggagttaccagccttcatcatccgtcgtttgcccgtgcgtttgacttatgataataactactttaacgatacttatcaaggtattccaatcggcggttacacgcagattgtagaaaaaatgttggaacatgaaaatatcgatgtggagacaaatgttgatttctttgccaataaggaagactatttagctacctatccaaagattgtctttacaggaatgattgacgagttctttgattaccaacttggtgaattggagtaccgtagccttcgatttgagacagaagtgttggatatggaaaactatcaagggaatgcggttgtcaactatacagatagcgagacaccatatactcgaatcatcgaacacaaacacttcgaatttggtacacaaccgaaaaccattattacacgtgagtattcgaagacctggaaacgaggcgatgagccatactatccagtcaacaatgatcgcaataaccatctatacacagcatataagaaattgtcagaacaacaagagaatgtcatattcggtgggcgtcttggtcattatcgttactacgatatgcaccaagtcatcggagctgccttacagtgtgtgagaaatgaagttggggaatgattttgagaagtcatcaaagtagtaattattcttggcagaagtcggaatgctcttaaaatgttaatcaaaaaaaccagaaattctggtttttttgattattattgaattgctgccaacaggtcagctacttgttgttcgagttttgttagagtttcgtcagataactccaatacacctgttccccatgcttctggattgatggttgaacctgtaaattcaccagcaatctgagtgcgaataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaattttaggaaggataggtatctcgatgtcttgattgaataggggaatttttgcaagatcaatgtaagatacttgagccttatcagtcaagaatgcttcagctttttttgccatttgatggttaaaagaaccgtcacgtagtgaaccaactaaaaacaatacgtttgccatgatggcctccttttcataaaaacataaatttagtatatcgtatttgtcttttgttgacaatcctaggtctgctgattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttctttataacgacagtcatgttgccagaagtgcttaataatttatcaattaagtcttgaatccgcagatttcctttgttgtagagtgcctccatcactccaaactgacaaactgtcagtccgtattttttgattgtttctaattctgattttgcgatagtattagctgctctgcgaaagacgactagactgtgaagtgcatgcttgttctcgtttaaagattgttcaacagttctcatgagaatattttagcaataaatcgttcggttatcaagcaaaaaaagttaaatcctatattcataggtaaagtacttttatggaaaagatagtttttagttaatcaagttcgttttttgaggtaatactaactgtactggaaaaaacgagcaatgagcatttgagaaatagtcttagatggaagtgcaaaactgtgaatgtaggtttttatatccttttctttgtgtgaaggaaaaggaaattttatttacaatcacagaaagaatggaaatatgctttaatttgtagtataatgggactattatggaaaaaaagatttttcaactgttggagtggatggcttccaagactggtcagttaatgttgggctcttttatccttctcagtgttgtgactttttcaatttttactatttgggatattgctgctgcccctttcaacaatgcgcgtagtcatgcagttggagtagctacagaatatgctgatttgcaaactgtcaatgatttttctatctacaatggtactgaaacctatttttgtgtatttggtgtcaccagtcagggagaagaggttgcagttttgattccagaggcttctagcacagtatatgtctattctttagctcagggaatttcgcaagaagaagcgcaagctattgccaagaaaaacggtgcaagccaagtagagcgaactattctaggtttaagggatggcaaacctatttgggaagtcaagtcaggtactgcctactatttagttgaatttgaaacagggaactttatcaaacgggagggcttatgagcaagctatcaaaacgtgtcttagaaatggaagaaagtgtcacgctggcagcgggtgcacgggcaaaggccttgaaggcagaaggacgtgatattttagagctgaccttgggtgagccagacttcgttacaccgaaaaatattcaagaagctgctattaagtctatcgaagatggtaaggcgagtttttatacggtagcttcaggtctgccagaattgaaggacgcggtcaatacctactttgagaacttctatggctactctatcgaacgcaatcaagtcgttcttgccactggtgccaagtttatcctttatgctttctttgcggcggtaatcaatcctggtgatgaggttctgattcccacaccttactgggtttcttatgcagatcaaatcaagatgaatgatggggtgcctgtctttgtcactgcaagtgaagagcacaatttcaaggtaacagttgaccagctggaagcagctcggacagataagaccaaagtattcctactcaatactccttctaatccgactggcatgatttacagtcgtgaggaattggaagctattggcaactgggctgtagagcacgacattctcatcttggcagacgatatttacggtcgtttggtatataatggaaataccttcacaccgatttcaagcatttcagaaagcattcgtcagcagactattgttgtcaatggggtggccaaggcctatgccatgacaggttggcgggttggatttgccgttggtaatcctgagatcattgcggctatgagtaagattgtcggacaaacgacgtcaaacttaacaaccgctgctcagtatgcggccattgaagcctttacaggtccgcaagatacggtcgaaaccatgcgtcaggcatttgaagagcgactcaataccatttatcccttgctggcagaagtgcctggttttgaagtgattaagccagaaggtgccttctatctcttcccaaatgtcaaaaaggctatggaaatgaagggctacacagatgtaactgaatttaccacagccattttggaagaagtgggagttgcaatggtgacaggtgctggttttggagctcctgagaatatccgcctcagctatgcgacagatatggacacgctcaaagaagcagtggctcgactacacacatttatgaaaaaataaaaagaggaaaaataatgtctagaaaattgattaccatcaaccaagtaaaagattatgtcggtcaagaagtgaccattggtgcctgggttgccaacaaatcaggcaagggcaagttagccttcctgcaattgcgtgacggaacagccttcttccaagcagttgccttcaaaccaaacttcatcgaaaaattcggtgaagaagctggtactgagaagtttgatgtagcaaaacgccttagccaagaaacgtctgtctatgtgacagggattgtcaaggaagatgagcgttctaagtttggttatgagttggatgtgacagaccttgaagtgattggtgagtcacaagattacccaatcacaccaaaagaacacggtacggacttccttatggacaaccgtcacctctggttgcgttctcgtaaacaggtcgctatccagcaaatccgtaacgccatcatctatgcgacttatgaattctttgaaaagaatggctttatcaagtttgatagcccaatcttgtctggaaatgcggcagaagattcgacagaattgtttgaaacagactactttggtcagcttgcctacctcagccaatctggtcagctttacctggaagctggtgccatggcccttggtcgtgttttcgacttcggtcctgttttccgtgcggaaaaatcaaaaactcgccgtcacttgacggagttctggatgatggatgccgagtattcattcctcagccatgaagagtcacttgacttgcaagaagcttatgtcaaagccttgattcaaggtgttatcgaccgtgctccacaagccttggcaactcttgagcgtgatgtggatgcccttaaacgctacattgcagaaccattcaaacgtgtggcttatgatgatgctattacccttcttcaagagcatgaagctgatgaagatacagactacgaacacatcgagcatggtgatgactttggatcgccacatgaaacttggatttcaaactactttggtgtaccgactttcgttgttaactatccagcaagcttcaaggccttctacatgaaaccagttcctggcaatccagagcgcgtgctttgtgcagacctcttggcaccagaaggctacggtgaaatcatcggtggttctatgcgtgaggacgattacgatgccttggtagccaagatggacgagctcggcatggacaagtcagaatacgaattctaccttgaccttcgtaaatacggctctgtgccacacggtggtttcggtatcggtattgagcgtatggtaaccttcgttgctggtacaaaacacatccgtgaagccattccattcccacgtatgttgcaccgcttgcatccataagcagatcaatagatatacaaacagactacacatgtggtctgttttcttgctttttcactgag

SEQ ID NO: 35 - DNA, 47715 bp, Streptococcus suis
ttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcatgccatttctttttaaggttgctggaagtccgttcgtagtagtcttcaaggatttcttccttggacttgtaattgcggtagaaggcattgcgtgacacaccagcttttcggaccaattcagataccgaaatttgcttgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatggggtagtttaatgatataattgtaagtaaatagagatttattgtcaaataaaaaaataaaattggaaatgagaatattatgacaaaatggaaaatcgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtcggcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgtagacgaaatcaatcgcttaattagtgcaggattagattttccacaagtagtagaagcgataactcactatcgggaacacagtaagctcctctttgttttagcgaaagttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgttatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctacgaagtgaaagcgtgattcacagagtaataattttgggctgtaatttccgctatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacattttccaaacatgtgttggatgctaggagaaagaatccccttgcttagctgaaaggtcacgctccctttggaaattcgatacgggatgtttaaagcgtatttctctagacagtcttttattttattccattgagcgtgataaatgtgatgaagatgctgtgtgttccgcgcaaacataccgttatcaatgtagagcgagagagctttttgcatgataagattggtatcgtagtcgattagactcttatgtttgatgaagatatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatctgctaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaattccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcttttagacaaatccgaaaatcttcatagggtaattcttgaaagtctgtaggattgagctctacagtatggtcttggaaatctctatcctctaagatataataaccgcttttttcgacagcgtagatcttattttggtattttaattccaacatagccttttggacagtgtctttgctacaatgatattgctcgcggagttgacggatagaaggtaatttctctccacgtttgaatcgatgttcctctattccagtcaaaatatcttggatgataacttgatattttttcatctaggtccccttttttatagactatgttactagctagtatatagaaaaaattgaagaaagacaatatatgaataatggggttgaggttcaggaattaagctactctatggtataattaagtgatgaaaataattatacctaatgcaaaagaagtaaatacaaatctagagaatgcctcgttttatctcctgtctgatcgaagcaagccggtgctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggcagaggaagattgctgtcctggttggctaagaacaatattcaggaattatcggacattcaagattttaaggtggatggctttgaatattgtacttccgaatcaacggcaaaccaacttaccttcatacgatcaataaaaatgtgaaattatgaaaaagataacgttttccagcgctaaaaagggtagaaaaatattaatttctatgatataatggatgcgttataggtaaaagtctaggaaggttgtttatgaaaaagagaagcggacgaagtaagtcgtccaagttcaaattggtaaattttgcgcttttgggactttattccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcgctcttacttgttttttcactggtcatcacgtctgttgggatctatggaatgcaagaagttgtaaaattttcaacacgactaaattcaaattcgacattttcagaatatgaaatgagtatccttgtcccagcaaatagtgatattacggacgttcgtcagcttactagtatccttgctccagccgaatacgaccaagataacatcaccgctttattggatgacatatccaaaatggaatctactcaactagcaactagccccgcgacctcttacctgacagcatatcaatctatgttgaatggcgagagtcaagcgatggtgttcaacggagtttttaccaatattttagaaaatgaagatccaggcttttcttcaaaagtgaaaaaaatatatagtttcaaagtgactcagactgttgaaacagctactaagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctggtatctacggtgtcaatgcttctgtgcacaccttagaaaatctctatgggattgacattagcaattatgtgcggttgaacttcatttccttccttcaattaatcgacttggtgggtggaattgatgtatataacgatcaagaatttacaagtttacatgggaattatcatttccctgttggacaagttcatttaaactcagaccaagcattaggcttcgttcgagagcgctactctttaacagggggtgacaatgaccgtggtaaaaaccaggaaaaagtgattgctgccttgattaaaaagatgagtacgccagagaatctaaaaaattaccaggcaatcctatctggattggaaggctcaattcaaacggatttgagcttagaaacgattatgagtttagtgaatacccaactagaatcaggaacacaatttacagtagagtcacaagcattgacaggaacaggacgctcagacttatcttcttatgcgatgcctggatcacaactttatatgatggaaattaaccaagatagtctggagcaatcaaaggcagcgattcagtccgtacttgttgaaaaataaagattttaggagaaaatatgaacaatcaagaagtaaatgcaatcgaaatcgatgttttattcttactaaaaacaatttggagaaagaaatttttaattctcttaactgcagtgttgactgcggggttggcatttgtctacagtagttttttagtgacacctcaatatgactccactacccgtatctatgtagtgagtcaaaatgttgaagccggtgcgggcttgactaaccaagagttacaagcgggtacctatttggcaaaagactatcgggaaattatcctatcacaagatgtattgacacaagtagcaacggaattgaatctgaaagagagtttgaaagaaaaaatatcagtttctattcctgttgatactcgtatcgtttctatttctgtgcgtgatgcggatccaaatgaagcggcacgtattgcaaatagccttcgcacctttgcagtgcaaaaggttgttgaggtcaccaaggtaagcgatgtgacgacacttgaagaagcagtcccagcggaagaaccaaccactccaaatacaaaacgaaatatcttgcttggtttattagctggaggtatcttggcaacaggtcttgtactggttatggaggttttggatgaccgtgtaaaacgtcctcaggacatcgaagaggtaatgggattgacattgctaggtatagtaccagattcgaagaaattaaaataggagaacaatatggcgatgttagaaattgcacgtacaaaaagagagggagtaaataaaaccgaggagtatttcaatgctatccgtaccaatattcagcttagcggagcagatattaaggttgttggtattacctctgttaaatcgaatgaaggtaagagtacaactgcggctagtctcgctattgcctatgctcgttcaggttataagaccgtcttggtggatgcagatatccgaaattcagtcatgcctggtttcttcaagccaattacaaagattacaggtttgacggattacctagcagggacaacagacttgtctcaaggattatgcgatacagatattccaaacttgaccgtaattgagtcaggaaaggtttctcccaaccctactgcccttttacaaagtaagaattttgaaaatctacttgcgactcttcgtcgctattatgattatgttatcgttgactgtccaccattaggactggtaattgatgcagctatcattgcacaaaaatgtgatgcgatggttgcagtagtagaagcaggcaatgttaagtgctcatctttgaaaaaagtaaaagagcagttggaacaaacaggcacaccgttcttaggcgttatcttgaacaaatatgatattgccactgagaagtatagtgaatacggaaattacggcaaaaaagcctaatttctcagataacataagtttgataagtaggtattaatatgattgatatccattcgcatatcatatttggtgtggatgacggtcccaaaactattgaagagagcctgagtttgataagcgaagcttatcgtcaaggtgttcgctatatcgtagcgacatctcatagacgaaaagggatgtttgaaacaccagaaaaaatcatcatgattaactttcttcaacttaaagaggcagtagcagaagtttatcctgaaatacgattgtgctatggtgctgaattgtattatagtaaagatatcttaagcaaacttgaaaaaaagaaagtaccaacacttaatggctcgtgctatattctcttggagttcagtacggatactccttggaaagagattcaagaagcagtgaacgaaatgacgctacttgggctaactcccgtacttgcccatatagagcgttatgatgctctggcatttcagtcagagagagtagaaaagctaattgacaagggatgctacactcaggtaaatagtaaccatgtgttgaagcctgctttaattggcgaacgagcaaaagaatttaaaaaacgtactcgatattttttagagcaggatttagtacattgtgttgctagcgatatgcataatttatatagtagacctccgtttatgagggaggcgtatcagcttgtaaaaaaagagtatggtgaggatagagcgaaggctttgttcaagaaaaatcctttgttgatattgaaaaatcaagtacagtaacctcatagaaatagtggaggagctatgaatattgaaataggatatcgccaaacgaaattggcattgtttgatatgatagcagttacgatttctgcaatcttaacaagtcatataccaaatgctgatttaaatcgttctggaatttttatcataatgatggttcattattttgcattttttatatctcgtatgccggttgaatttgagtatagaggtaatctgatagagtttgaaaaaacatttaactatagtataatatttgtaatttttcttatggcagtttcatttatgttagagaataatttcgcactttcaagacgtggtgccgtgtatttcacattaataaacttcgttttggtatacctatttaacgtaattattaagcagtttaaggatagctttctattttcgacaacctatcaaaaaaagacgattctaattacaacggctgaactatgggaaaatatgcaagttttatttgaatcagatatactatttcaaaaaaatcttgttgcattggtaattttaggtacagaaatagataaaattaatttaccattaccgctctattattctgttgaagaagctatagagttttcaacaagggaagtggtcgactacgtctttataaatttaccaagtgaatattttgacttaaagcaattagtttcagactttgagttgttaggtattgatgtaggcgttgatattaattcattcggttttactgtgttgaagaataaaaaaatccaaatgctaggtgaccatagcatcgtcactttttccacaaatttttataagcctagtcacatcttgatgaaacgacttttagatatacttggagcagtagtcgggttaattatttgtggtatagtttctattttgttaattccaattattcgtagagatggtggaccagccatttttgctcagaaacgagttggacagaatggacgcatatttacattctacaagtttcgttcgatgtttgttgatgccgaggtacgtaagaaagaattaatggctcaaaaccagatgcaaggtgggatgttcaaaatggacaacgatcctagaattactccaattggacacttcatacgaaaaacaagtttagatgagttaccacaattttataatgttctaattggagatatgagtctagtcggtacccgtccgcctacagttgatgaatttgaaaaatatactcctagtcaaaagagaagattgagttttaaaccagggattacaggtctttggcaagtgagcggaagaagtgatatcacagattttaatgaagtcgttaggctggacctaacatacattgataattggaccatctggtcagacattaagattttattgaagacagtgaaagttgtattgttgagagagggaagtaagtaagactcctttaaaacaaagaatagtagtaggggatatgagaacagtttatattattggttcaaaaggaataccagcaaagtatggtggtttcgagactttcgtagaaaaattaactgagtatcagaaagataaatcaattaattattttgttgcatgtacaagagaaaattcagcaaaatcagatattacaggagaagtttttgaacataatggagcaacatgttttaatattgatgtgccaaatattggttcagcaaaagccattctttatgatattatggctctcaagaaatctattgaaattgccaaagatagaaatgatacctctccaattttctacattcttgcttgtcggattggtcctttcatttatctttttaagaagcagattgaatcaattggaggtcaacttttcgtaaacccagacggtcatgaatggctacgtgaaaagtggagttatcccgtccgacagtattggaaattttctgagagtttgatgttaaaatacgctgatttactaatttgtgatagcaaaaatattgaaaaatatattcatgaagattatcgaaaatatgctcctgaaacatcttatattgcttatggaacagacttagataaatcacgcctttctccgacagatagtgtagtacgtgagtggtataaggagaaggaaatttcagaaaatgattactatttggttgttggacgatttgtgcctgaaaataactatgaagtaatgattcgagagtttatgaaatcatattcaagaaaagattttgttttgataacgaatgtagagcataattccttttatgagaaattgaaaaaagaaacagggttcgataaagataagcgtataaagtttgttggaacagtctataatcaggagctgttaaaatatattcgtgaaaatgcatttgcttattttcatggtcacgaggttggaggaacgaacccatctttacttgaagcactttcttctactaaactaaatcttcttctagatgtgggctttaatagagaagtaggggaagaaggagcgaaatactggaataaagataatcttcacagagttattgacagttgtgagcaattatcacaagaacaaattaatgatatggatagtttatcaacaaaacaagtcaaagaaagattttcttgggattttattgttgatgagtatgagaagttgtttaaaggataagttatgaaaaagattctatatctccatgctggagcagaattatatggggcagataaggttctcttggaacttataaaaggcttagataagaatgaatttgaagcgcatgttatcctacctaatgatggagtcctagtgccagcattaagagaagttggtgcgcaagttgaagttattaactatccaattctacgtaggaaatattttaatccaaaagggatttttgactacttcatatcatatcatcactattctaaacagattgctcaatatgccatagaaaataaggttgacataattcacaataatactaccgctgtcttagaaggcatttatctgaagcgaaaactcaaattacctttgttgtggcatgttcatgagattattgtcaaacctaaattcatctctgattcgatcaattttttaatggggcgttttgctgataagattgtgacagtttcacaggctgtggcaaaccatataaaacaatcacctcatatcaaagatgaccaaatcagtgtaatctacaatggggtagataataaagtgtattatcagtccgatgctcggtctgttcgagaaagatttgacattgacgaagaggctcttgtcattggtatggtcggtcgagtcaatgcgtggaaaggacaaggagattttttagaagcagttgctcctatactcgaacagaatccaaaagctatcgcctttatagcaggaagtgcttttgaaggagaagagtggcgagtagtagaattagaaaagaagatttctcaattaaaggtctcttctcaagtcagacgaattgattattatgcaaataccactgaattatataatatgtttgatatttttgtacttccaagtactaatccagaccctctaccaacggttgtactagaagcaatggcatgcggtaaacctgttgtcggttaccgacatggtggtgtttgtgagatggtgaaagaaggtgttaacggtttcttagtcactccgaactcaccgttaaatttatcaaaagtaattcttcagttatcggaaaatataaatctcagaaaaaaaattggtaataattctatagaacgtcaaaaagaacatttttcgttaaaaagctatgtaaaaaatttttcgaaagtctacacctccctcaaagtatactgattggctgaagtgaatgctttagtatagcgatttatcgtattatcattcgataaaacaaatgttcagaaacagttataagttatttctaaagggcacctctataaactcccaaaattgcgaatttggagttacgaaagccttgttaaatcaacattttaaattttagaaaattagtttttagagctcccctaaaatagaagataacagaagggagccttcaaaaacttcatttttaattggattgtagaaaaactgttaaatcaatatttagatttttaggagttcagtttttggggggagagcttaataatctatgcactatatttcgaaaaatatatggtgtaaaatcagaactgatggtcgtggcaaaaaagagaatgaggaatttatgaaaattatttcttttacaatggttaataacgaaagtgagataatagagtcatttatacggtataattataactttattgacgagatggtcattattgataatggttgtacagataacacgatgcaaattatttttaatttgattaaagagggatataaaatatccgtatatgatgagtctttagaggcatataatcagtatcgacttgataataaatatctaacgaaaataattgctgaaaaaaatccagatttgataatacctttggatgcggatgaatttttaacagccgattcaaatccacggaaacttttggaacaactggacttagaaaagatacattatgtgaattggcaatggtttgttatgactaaaaaagatgatattaatgaatcgtttataccacgtagaatgcaatattgttttgaaaaacctgtttggcatcattctgatggtaaaccagttactaaatgtataatttccgctaagtattacaaaaaaatgaatttaaagctatcgatgggacatcacactgtttttggtaacccaaatgtaaggatagaacatcataatgatttgaaatttgcacattatcgagctattagccaagagcaattaatttataaaacaatttgttacactattcgcgatattgctactatggagaacaatatcgaaacagctcaaagaacaaatcagatggcgctcattgaatctggcgtggatatgtgggaaacggcgagagaagcctcttattcaggttatgattgtaatgttatacatgcaccaattgatttaagtttttgtaaagaaaatattgtaataaaatataacgaactatccagagaaacagtagcagaacgcgtgatgaaaacgggaagagaaatggctgttcgtgcatataatgtggagcgaaaacaaaaagaaaagaaatttctaaaacctattatatttgtattagatgggttaaaaggagatgagtatattcatcccaatccatcaaatcatttgacgatcttaactgaaatgtataacgtcagaggcttacttaccgataatcaccaaattaaatttctcaaagttaattatagattaattataactccagattttgctaagtttttaccgcatgaatttattgttgtaccagataccttggatatagagcaagttaaaagccagtatgttggtacaggtgtagacttgtcaaagattatttctttaaaagagtatcgaaaagagataggctttattggtaatttgtatgcgcttttaggatttgttccgaatatgctcaatagaatttatctatatattcagagaaacggtattgcaaacactattataaaaatcaagtcgagattgtgagagttgtttacttttatttgtaattttaaaagtaatgcaggcagataggagaaaaacgtttggaaaaatgagaataagaattaataatttgttttttgttgccatagcgtttatgggcataattattagtaattcgcaagttgttctagcgataggcaaagcttctgtgattcagtatctatcttatttagttttgattttatgtatagttaatgatttattaaaaaataacaaacatattgtagtttataaattagggtatttgtttcttattatatttttatttactatcggaatatgtcagcaaattcttcctataacaactaaaatatatttatcaatttcaatgatgattatttcagttttagcaacgttgccaataagtttgataaaagatattgatgattttagacggatttcaaatcatttgttattcgctctttttataacttcgatattaggaataatgatgggggcaacgatgttcacgggggcagtagaaggtatcggttttagtcagggttttaatggaggattgacgcataagaacttttttggaataactattttaatggggttcgtattaacttacttggcgtataagtatggttcctataaaagaacggatcgttttattttaggattagaattgtttttgattcttatttcaaacacacgctcagtttatttaatactattgctttttctatttcttgttaatcttgacaaaatcaaaatagaacaaagacaatggagtacgcttaaatatatttccatgctattttgtgctatttttttatactatttctttggttttttaataacacatagtgattcttacgctcatcgcgttaatggtcttattaatttttttgagtattatagaaatgattggttccatctaatgtttggtgcagcggatttggcatatggggatttaactttagactatgctataagggttagacgcgttttaggttggaatggaacgcttgaaatgcccttactgagtattatgttaaaaaatggttttatcggtctggtagggtatgggattgttttatataaactttatcgtaatgtaagaatattaaaaacagataatataaaaacaataggaaagtctgtatttatcattgtagtcctatctgcaacagtagaaaattatattgtaaatttaagttttgtatttatgccaatatgtttttgtttattaaattctatatctactatggaatcaactattaacaaacaactgcaaacataaattggcaggaatagagttttgagttgctattaatttggtagagcatatgttctataggtggcaagatagaagatagtattttttacatgatgatttttatgatagcaaagcaagttacggcataaaaggaattagaggatggaaaaagtcagcattattgtacctatttttaatacggaaaagtacttaagagagtgtttagatagcattatttcccaatcgtatactaatctagagattcttttgatagatgacggttcttcagattcatcaacggatatatgtttggaatacgcagagcaagatggtagaataaaacttttccggttaccaaatggtggtgtttcaaacgcaaggaattacggtatcaaaaatagcacagcaaattatattatgtttgtagattctgatgatattgttgacggcaacattgttgagtccttatacacctgtttaaaagagaatgatagtgatttgtcgggagggttacttgctacttttgatggaaattatcaagaatctgagctgcaaaagtgtcaaattgatttggaagagataaaagaggtgcgagacttaggaaatgaaaattttccaaatcattatatgagcggtatctttaatagcccttgttgcaaactttataagaatatatatataaacaaaggttttgacactgaacagtggttaggagaggacttattatttaatctaaattatttaaagaatataaaaaaagtcagctatgtaaacagaaatctttattttgctagaagaggtatacaaagtactacaaatacgtttaaaaaagatgtttttattcaattagaaaatttagaagaaaaaacttttgatttgtttgttaaaatatttggtggacaatatgaattttctgtttttaaagagacgctacagtggcatattatttattatagcttattaatgttcaaaaatggagatgaatcgcttccaaagaaattgcatatatttaagtatttatacaataggcattctttagatactctaagtattaaacgaacgtcctctgtttttaaaagaatatgtaaattaattgttgctaataatttgtttaaaatttttttaaatactttaattagggaagaaaaaaataatgattaacatttctatcatcgtcccaatttacaatgttgaacaatatctatccaagtgtataaatagcattgtaaatcagacctacaaacatatagagattcttctggtgaatgacggtagtacggataattcggaagaaatttgtttagcatatgcgaagaaagatagtcgcattcgttattttaaaaaagagaacggcgggctatcagatgcccgtaattatggcataagtcgcgccaagggtgactacttagcttttatagactcagatgattttattcattcggagttcatccaacgtttacacgaagcaattgagagagagaatgcccttgtggcagttgctggttatgatagggtagatgcttcggggcatttcttaacagcagagccgcttcctacaaatcaggctgttctgagcggcaggaatgtttgtaaaaagctgctagaggcggatggtcatcgctttgtggtggcctggaataaactctataaaaaagaactatttgaagattttcgatttgaaaagggtaagattcatgaagatgaatacttcacttatcgcttgctctatgagttagaaaaagttgcaatagttaaggagtgcttgtactattatgttgaccgagaaaatagtatcataacttctagtatgactgaccatcgcttccattgcctactggaatttcaaaatgaacgaatggacttctatgaaagtagaggagataaagagctcttactagagtgttatcgttcatttttagcctttgctgttttgtttttaggcaaatataatcattggttgagcaaacagcaaaagaagcttctccaaacgctatttagaattgtatataaacaattgaagcaaaataagcgacttgctttactaatgaatgcttattatttggtagggtgtcttcatcttaattttagtgtctttctgaaaacggggaaagataaaattcaagaaagattgagaagaagtgaaagtagtactcggtaagaatgttgtaataaatggttgaaagaaaaggggattaaaatgaatccaacaaatagtagaatagcactctttgatacgattaaatgtatcatggtactttgtgttatttttacacatctggattggtctgttgagcagcgtcaatggtttatctttccgtatttcgttgacatggctgttccaatttttctgttgctttctgcctattttcgaacgaataagtggaatacaaaacaagagacgctaaagctcaagttcagcagtggtataaaagaaagtataaacatgctttgtctctatgctatcgtgatggctgttaatgttttattgagctattcgagaaccatctgataggagtaaagcctttttcaggttcttcatcgctccgttcatttgtcctgtggctactttctggagaatcgggtccagggagttgggagttactatgttccgttgttgattcaggtagtttttttattaccaattttgtatgttcttttcgagaaaaataaatggttgggcttgcttacttgttttttagtaaacttttcagtggatgccatatttgctaacatggctgaacacggcatatatatatagactaatatcacttcgttatctttttgttctagggcttggttttttctttcaaagcaggatgtgcgttccaaggtagatactttcattgcgaccctatttgggattattggagcaattctgatttttgtgaatcattctatagagcccttctcctggttttatggttggaagtctacttcctttctatgcgtcccatttgcgtatgctatgctattttttatgataaagtatggacagaagattccagcaatactgttgtcaaaattgggagttgcttcttatcatatctacttgacccagatgctgtatttttcagtagtcgcaccatttttagcagtgcaatttaaggtatcttcgttgaatttgtggaacggcttgtttacctttctaatttgcctgtttggtggctatattttctacaaagtggatctgtttatgagagtacgtggaaaacgataatgactcatttcagattagcagatgccatttcgtttattagcagattcgcatgttaatattccgacaaagaaattcaaataggttgacgagagaggagtggtatctgtttctaaaccccagtatccccctttattttcaaagctatatttattaactgaacaaggagaatttttaagagaactgtttgtttaatcccagcacgatctggttcgaaaggcttaccgaataaaaacatgctatttttggacgggaaacccatgatttttcacacgattgatgtggcaattgaatcaggttgttttgagaaagaagacatctatgtcagtacggattcagaaatgtataaggggggcacctctataaattcccaaaattgcgaatttggagttacgaaagccttgttaaatcaacatcttaaattttagaaaattagtttttagaggtccccaaggggatttgcgagacaagaggcatcaatgtattgttaagacccaaagaactatctacttatcatactccatcgaatgaagtcagtacgcacttttttacgaatctggattttatgaagattgtatatttgttcttctgcaagtcacctcaccgttacggactggcgaacagataaaagaagccatgaatatgtacttacagggggactcagaaaatgttttgcatttcaatgatgaagggcaagaaagagtgaatcagtacattatcgaagctgtacaggggttataaaaaggggttacttatccttaaagtctgtatgtagaaggagaaaaattgagacgaatttatatttgccatacgatgtatcagatcctgatttccttgttaaagatggacgttgagagagatagtttgatgtccgttgatatcatcgggcattttccagatgtcagggagcaactgcagcagcatgttcatctaatcgaggagacggagcgttcatttgatctatattctttgatagctagatcaaaaacaaaagaacgcctttccttgttacagagctatgacgaggtgatcatttttcaagatcaccgtcaagtcggtcattttttaaataaacatcggattccctattctcttttggaggatggttataattttttcaaggataaaagagtgtgcgatttggagtcaattcaatcatctgtctggaaaagactcttttatcaatggtattttaaaccaacatatttgattggttcaagtctctattgtcaatccattgaggtcaatgatctgtcgctcgtacaatttgacgaggcttataaaccctttgtagaagttccgagaaagcaattatttgatcaagcatcgccagagaaggtgcaagcgctgctgcagatatttggagcaagggcgatagtagcggatgaagagtcttctcaaaaacgattgctattattgacccagcccttgtcttgggattatcatgtgaccgaagaggagttgttggagatttatgtagcaggtcttgccccttatcgggaagactatacaatctacataaaaccgcacccacgagatggggttgattattcatttctgggtaaggctgtggtgcttctgcctcaaggtattccgtttgagttgttcgaaatggcaggtagtatccgttttgatatcggtatgacctatagttcgtctgctttagattttttaaattgttttgaagagaaagtgtatttaaaggacacttttcctcttctttcaaaaaatgatattttgcgtgaggggatagaataggaggattcatgtctaaaaaatcaatagttgtctcaggtctcgtctatacgattggaaccatcctcgttcagggattagccttcattaccctccccatctatactcgtgtcatttctcaggaagtatatgggcagtttagcttgtataattcgtgggtggggctagttggtctctttatcggtctacagttaggtggggcttttggcccgggatgggtacacttccgcgagaaatttgatgatttcgtatccaccttgatggtctcttctatcgctttctttttaccaatttttgggctatcttttctcctcagtcagcccctatcgctcctatttggtttgcctgattgggtcgttccgcttatctttttgcaaagttttatgagtgttgtgcaaggattttttacgacctatttagtgcagcggcagcagtccatgtggactttactcctatcggtactgagcgctgttatcaacactgctttatctttatttctcatcttttcgatggagaatgatttcatcgctcgtgtaatggcaaactcggcaacgactggtgtttttgcttgtgtgtccttgttgtttttctataagaagattgggcttcattttcgaaaggactatcttcggtatggtttaagtatatcgattcctcttatttttcatggattaggtcataatgtactcaatcaatttgacagaatcatgctcggcaagatgctaacactgtcagatgtagccctatacagtttcggctacacacttgcgtctatcttacaaattgtgttttcgagcttgaatacggtatggtgtccgtggtattttgagaaaaagagaggtgcagataaagatttgctcagttatgtccgttactatctggcgattggcctgtttgtgacttttggatttctaacaatttaccctgaattagcgatgttgttaggtggatctgagtatcgtttcagtatgggatttattcccatgattattgtcggggtgttctttgtatttctttatagttttccagccaatatccagttttatagtggaaatacaaagtttttgccaattggtacttttatagcaggtgtactaaatatttcagtcaactttgttttgataccgacgataggaatttatggtgctgctttggcaacgactgcttcctatctgttgttgctagtcttgcattattttgttgctaagaaaaagtatgcttacgatgaagttgcgatttcaacatttgttaaggtaattgctcttgttgtcgtctatacaggcttgatgacagtatttgtcggttcaatctggattcgttggtcactaggaatagcggttctagtcgtttatgcctacatttttagaaaggaattaacagttgccctcaatacattcagggaaaaacggtctaaataagggcacctctataaactcccaaaattgcgaatttggagttacgaaagccttgttaaatcaaacattttaaattttagaaaattagtttttagaggtccccatataaaaacgtcccaaatgagaggtgctcataagaattgaccatcactgccatctacccaaagttcaagtattctctaccatgaaaattgtgctataatcaagtataaagaagggaatgtttcttaaaggacgtatgcgcctctgcttatgccagaagtcatgaggtaaatctccctaaaaattgggtagaaaagcagattaaacttccaccaatctattgaagatcgtgtgaagaagcaggctttagaagcaacaagccctgagactattcgaaagaaatctagggctattttttctaatcggctatcagaagtgaagtagcgatctttattagtgttcttttactacttaaggaaaaccaagctgctccctcaagactttatgggagcgatttacagtcatttttagaaaggaaataaaatggtttatattattgcagaaattggttgtaatcacaacggtgatgttcatctagcacggaaaatggtagaagttgccgttgattgtggtgtggatgccgttaaatttcagacatttaaggcagatttgttgatttcaaaatacgcaccaaaggcagaataccaaaaaattacaacaggagagtcagattctcagctcgaaatgactcgtcgtttggaattgagctttgaagagtatcttgatttgcgtgattactgtcttgaaaagggagttgatgtgttttcgacaccttttgatgaggaatcattggacttcttgattagcacagatatgcccgtttataagattccatctggtgagattaccaatcttccctatttggaaaaaattggtcgtcaagctaagaaagttattctttcaactggtatggctgttatggatgaaattcatcaagcggtgaagattttgcaggaaaatggaacgaccgatatttcgattttgcattgtacaaccgagtatccaaccccttaccctgctttgaatttgaatgtcttgcataccttgaaaaaagaatttccaaacttaacaattggctattcagaccatagtgttggttcagaagtacccatcgctgctgcagcaatgggagctgaattgattgaaaagcactttactctggacaatgaaatggaaggaccagatcataaagcgagtgctactcctgatatcttagcagccttggtaaaaggagtgaggatagtggaacaatctcttggtaaatttgaaaaagagccagaagaagttgaagtacgaaataaaattgtagctagaaaatctattgttgccaaaaaagcaattgctaaaggcgaagtctttacagaagaaaacatcactgtcaaaagaccaggaaatggaatttcgccaatggaatggtacaaagtcttggggcaggtgagtgagcaggattttgaggaagaccaaaatatttgccatagtgcttttgaaaatcaaatgtaagcggagtaaggatgaaaaaaatttgttttgtgacaggctctcgtgccgaatatgggattatgcgtcgcttattgagctatctacaggatgatccagaaatggagctggatcttgtagtgacagccatgcatctagaagaaaaatatgggatgacggtcaaagacatcgaagcggacaagcgtaggattgtcaagcggattccattgcatttgacggatacgtctaagcagacaatcgtcaaatctttagcgaccttgacagagcaactcacggttctttttgaagaagtccagtatgacttggtgttgattctgggggatcgctatgagatgctaccagttgccaatgctgcgttgctttataatattcctatttgccatattcatggtggtgaaaaaaccatgggaaattttgatgagtcgattcgccatgccattaccaagatgagtcaccttcatctgacatcaacggatgaatttagaaatcgtgtcattcaactaggagaaaatcccaaccatgtactgaacatcggagctatgggtgttgaaaatgttttaaaacaagactttttgacaagagaagagttggcgatggaacttggaattgattttgccgaggattactatgttgtactctttcaccctgttaccttggaggataacacagccgaagaacaaacgcaggccttattagatgctctaaaagaagatggtagccagtgtttgataattggatccaattcggatacacatgccgataagataatggaattgatgcatgaatttgtaaaacaagactctgattcttacatctttacttcgcttccaactcgttattaccattccttggtcaagcattcacaaggtttaatagggaattcttcgtcaggtttgattgaagtgccctcattacaggttccgaccttaaatattggaaatcgccaatttggacgtttgtcaggaccgagtgtggtacatgttggaacttctaaggaagcgattgttggtggtttggggcaattacgtgatgtgatagattttaccaatccatttgaacaacctgattctgctttacaaggttatcgagctatcaaggaatttttatctgtacaggcctcaaccatgaaagagttttatgatagataggggagaaagtttgatgaaaaaagtagcctttctaggagcgggtaccttttcagatggtgtccttccttggttggatagaagtcgatatgaactcattggatattttgaagataaaccgatcagtgactatcgtggctatcctgtatttggtcccttgcaagatgtcctaacctatttggatgatggaaaagtagatgctgtcttcgtcactataggtgacaatgtcaagcgcaaggaaatctttgacttgcttgccaaagatcattatgatgctttgttcaacatcattagcgagcaagccaatattttttccccagatagtatcaagggacgaggggttttcataggtttttcaagttttgtaggagccgattcctatgtctatgacaattgtatcatcaatacgggtgccattgtggaacatcataccacggtggaggcccattgtaacattactccaggagtgaccataaatggcttgtgccgtatcggagaaggcacttatattggaagtggttcaacagtgattcaatgtatcgagattgcaccttatacaacattgggggcagggacagttgttttgaaatcgttgacggagtcagggacctatgttggtgtacctgctagaaagattaaataggtgaattgatggaaccaatttgtctgattcctgctcggtcaggatcaaaaggtttaccaaataaaaacatgttatttttagatggtgtaccgatgattttccataccattcgagctgcgattgagtctggatgttttaagaaagaaaatatatatgtcagtactgattcagaggtttacaaggaaatttgtgaaacaactggggttcaagtcctcatgcgtccagctgacttggcgacagattttacaacctcttttcaactgaacgaacattttttacaagatttttctgatgaccaagtatttgttctcctgcaagttacgtccccattaagatcgggaaaacatgtcaaggaggcgatggagttatatgggaaaggtcaagctgaccacgttgttagctttaccaaagtcgataagtctccaacattgttttcaactttagacgaaaacggattcgctaaggatattgcaggattaggtggcagttatcgtcgtcaagatgagaaaacactctactatcctaatggagcgatttatatttcttctaagcaggcttatttagcggataaaacttatttttctgaaaaaacagcggcctatgtgatgacgaaggaagattcgattgatgtagatgatcactttgattttactggtgttattggtcgaatttactttgattaccagcgtcgtgagcaacaaaacaaaccattttataaaagagagttaaagcgtttatgtgagcaacgagtccatgatagtcttgtgattggcgatagtcgtctgttagccttgttactggatggtttcgataatatcagcatcggtgggatgacagcttcgacagcacttgaaaaccaaggtctctttttggctactccgataaagaaagttttgctttctcttggtgtgaatgatttgattactgactatcccttgcatatgattgaggatactattcgccagctgatggaaagtcttgtttccaaagcagagcaggtttttgtgacgacgattgcctacacgctgtttcgtgatagcgtttcaaatgaagaaattgtgcagctgaatgacgttattgttcagtcagcaagtgaactgggtatttcagtgattgatctaaatgaagttgttgaaaaagaggcgatgcttgactatcagtataccaatgatggattgcatttcaatcagattggacaagagcgtgtgaatcagctgattttgacaagtttgacaagataatttggtgatagaagctatttcagtggctagactatgttggtatgtgttttagagccaaggaataacatctgtagaggatgctagccttgagaattgacaaccatttagttgtttaattatataaggggacctctaaaaactccctaaatttcccaaaaatgagataatagaataaaaagtaatgaggagagctgtcatgcatttattcacagacgatgaaaaaatcttgtcaaaactatcagagaaaggcaatcccttagaacgtttggatgccgttatggattggaatatctttcttccattgttgtcagagttattcagtcgtaaagataaagtcatcagtcgtggcggtcgtcctcacctagactatctcatgatgttcaaagcgctcttgcttcaacgtcttcataacctatctgacgatgccatggaatatcaactgctggatcgtatatcttttcgtcgttttgttggttgtcatgaagacactgttcccgatgcgaaaactatctggctctatcgtgagaaattaaccaagtcaggtcgtgaaaaggagttgttcgatttgttctatgcccatctcacagatgaaggggtgattgcccattcaggtcagattgtggatgctacctttgtcgaatgccctaaacaacgcaattcacgtgaggacaatcagaaaatcaaaacttatcgaaaattatgaggtcacaacagctagtgtacacgactccaatgtcctagctcctctttgtgatgccaatgaagcggtttttgatgacagtgcttatgttggaaaatcagtaccagaaggttgtcgccaccacacgattcgtcgtgcttttagaaataaaccgttgactgagactgataaggtcattaatcgacatattaccaaagtccgttgtcgcgttgagcatggttttggcttcattgaaactaacatgaaaggtaacatctgtcgagcaattgggaaggcacgagctgaaaccaatgtgaccttaaccaacctgctctacaatatctgtcgttttgagcaaatcaaacgactgggattaccatcgtgggcttagtgcgcccaaaaataggaaaataagcaaaaagaggctgggcaaaaactagtttctcacaataaaaaaacggctctttgtcaactgtagtgggtagacgaaaagctaacacctagagaggacgaaattcgttctctcatttttgatgtttaaagcgtaaccgcctaataacaaggtatctatccaatcacacattcctccattatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatactgttataaaaaacaaactggaggattcattatgtcacagcccgtcgtcccattgactattccccaatctcgccgctttgaaaagaaaagcagaaacgatattctgatgaaaattcgtctcggaaaaacggaagtcacattcttccaatctatcaaccctgaagtaatggaaacaatcttggataaggtactgcattatgaccatccgactcagtgatttaggtcaagtcttcttggtctgtgggaaaacggatatgcgtcaggggattgactctctcgcctatcttgtcaaaagtcaatttaatctggatcccttttcaggtcaggtctatctcttctgcggaggtcgaaaagaccgattcaaagctctttactgggatgaacagggattttggttattgtataaacgttttgaaaatgggaaattggcctggtcaaacaatgaagaagaagtcaaggctctaacttccgaacaagtagattagctcatgaaaggattttctatcattccaaaaataaatgtttcaaaaagtcgtgatttctattgaaatcatggcttttctttgtgtataatgagataaaaagaaggaggagcgagcgtatggatgagttgttggcaattattaaacaacagacctcaacgattgaacaacttaccaatgagctaaccctccttcgagaacaggttgactatctgagacagaaactctacggaaaatcatcagagaaagttgtgtatcaacccggtcagctgagcttgtttggggaggaaagcctccctgaagaagaagctgacttacccagttgaaacagagatcatcacttataaacgcaagaaaactaagggagttcgtcaggctatttttagtcagttcactccagagatagtgcatcacgaattgcagggcgaagactgcacttgtccagactgtcatggtcagttgaaagagattggctcagctgttcaacgacaagagttggtcttcattcctgcacaattaaagcggattgaccatgttcaacacgcatacaagtatcaggcatgtagccagaagaatctgagcgataagattatcaaggctcccgttcctaaggcacctttggcacacagcttgggttcagcctctatcatcgctcacaccattcatcagaagttcaatttgaaggtgccaaattaccgtcaggaagaggattggcataagcttggcctgcccatcagtcggaaggaaatagccaactggcatatcaagtctagtcagtattatttcgagccgatttacaacctgttgcacgagaaattgttggagcagcctattctccatgcggatgagaccgcctacaaggtcttagaaaatgatggtcagttgaccttcttgtctgggaaacatgaggaaaatggaattaccctctatcatcatgacaaacgacggagtggcttggttgtggaggaggttcttggggactatgcgggctacgtacattgtgacatgtggagtgcttatcgtcaattagacaaggctcagctggttggttgttgggctcccgtcaaacgaaagttctttgaggcgactcctaagaagacagacaagacttctttaggagcccaagggcttagcctattgcgaccgcctgtttgccttggagagttgactgggctgacttgtctagcgaggagcgactgcataaacgctggctcccttgatggacgagttctttgactggtgtcgtgagcaatctgttttgccaggctccaaattgggtactgctttggagtatagcctcaaatacgaaaccaccttccgaaccgttctctcggatggtgacttggtcctgtctaacaacatggctgaaagggctatgaagaccttggtgatgggcagaaaaaattggttgttctcccaaagttttgagggagccaagtcgacagctatcattttgagtcttttggaaacggccaagaggcacgaacttgatacagagaaatatatgacctatcttctagacaatctacctaacgaggaaacactcgctaaaaaagaagttctagaggcttatttgccatgggagaagaaaattaagagagcatgtaaatagaaaaaggttccagagtcaacaggactttggagccttttcaatataccttattattgggcggttacaaagtagcctaggaaacgaagccgaagatagaactggagttggagttcatcaaggcaagttgacaacggataattttgattttcgaagagtatcaataaaaatcaaagatagcaagtctaagctacttatgaaagttctataatgaagtcaaacgtgggacaactttacaacaagtgcgaaaagggctgtacaaaaaagtctattctgctgactatgcacaaacggtataccgaactaatcgaaaacgatcggtaaaaaagataatcctaacgaaagaattgaaagagaaaattttacactatactaagcaaaaattttctcctgaaatgatggttaagaagaagaaaatgaaagtgggtatttcaaccatttactattggtttcatcatggccatttaggattgacgaaagcagatatgctttaccctagaaaagggaaaagggtcaagaagcaagctagtcctaactttaaaccagcaggaaaatctatcgaagaacgtcctgacgttattaatcttcgcttggaaaacggtcattatgaaattgatacagttctactaaccagagggaaaaatcattgcctcttagtcttaaccgaccgacgaagcaggcaccaaatcatacgattaattccaaacaaaaccgccgaatcggtcaatcaggcactggagggaatcttgagggaacatcgtatcctgtctataactgtagataatggtacagaatttagtcgtctggctgaagtgtttcctgaggagtatatctactatgcgcatccctattcttcatgggagaggggaacgaatgaaaatcacaatcgattgattcggagatggttacctaaaggaaccaagaaaacgactccaaaagaagtcgcttttatcgaacattggatcaacaactaccctaaaaaatgcttggactacaagtcgccgagtgaatttcttatgggtggctaatttcaacttgaaatttggggtctaagctacttataacatttgaaaccttaatttataagtttgagttgaggattgtggatttcaagcagctgttttcttctaaaaaaataacaaaatcgaaacggtccatatccactttgagtggtagttggctatttttgattttaaatgagtatcacaccccatcgtcccattgactgttccccaatctcgccgctttgagaagaaaggcagaaatgatattctgatgaaaattcgtctcggaaaagtggaagtcacattctttcactctatcaaccaagaaacattagaaacaatcttagataaggtactattttatgaccatccgactcagtgatttaggtcaagtctacttggtttgcgggaagtagtggtgtgatttggttaagaggattatgctcacttagaatttctacctgcttgctttgagagacatgagtgtagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagacttaagcgcacactttgttctttaagatgatcatcgttttcacactggtaaatagataactagaatgactacaatgatgcgctatatagtcttcaagtaacgaaagtgttttatcgtttccaatatagagtagtcgcactttctttccttttccgagtatttgaatggttctattttccaaattgatattatcaagttttaaattacataattcagagatgcgtagaccagttgataaaagtagcgagataaggagtagatttcgcatagctttccgattagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagtcttttttatatgttggttgagaaaagtaagataggacctaatatcattggtcctaaagctataatactaatgtaaattggatttgtatgcttggatagtatgagaactaagtcgtctttgaatagcacaaaagtcaagatatctctggatagtgtcgtaattcataatataatctccttaatatgtcgtaataaagctattatatacgataatttatcaatttactaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctggtcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgctgattccctctttttgcgattactttagcattaattatacaggttcaaatgcactaacagtttcattatgtcgtaataaatttatttggggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtcccttttttaatattaaagggaaatatcttgtattagatccagtcaaaattgtctcttcttcagaaattataacaagcaaactatctgataataatagttattcatttgaatggttggaagatcaacaaatatgtacaaaattaaaagagtcaacaaaaaaactcgccaagtacttaggtataaccacttacggacgagttgattttagaataaagtcagatgggagttattttgtttttgatattgcaacaatgccttacacaactgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcacctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctatattaagtttatctattaaatgaggtaatagcatgtaaatacatgaaagatagtgaataggctcaacaataacatctttggcgctttcagctaatatattttcgtaaagtgtatcacaaagtgaatgaaaagaaaaatcttgtgatgtatttccttgaaagttaatatcattctttaataatatcgaagataataatgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattacctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaatttttctgcaaatgaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattccaatgagacataattaaactttcctaccgataacaatttattatcattagcataccataatctacatttgttttatagattttattaaaatttttatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaagaagcgtagaaaaactaaagggaacgattcgtgtcccaggtgataaatcaatcagtcatcgttctattatttttggttcccttgcaaaaggtgttacccgtttccacaatattttacgtggggaagatgtcttgtcaaccatgcaggtctttcgtgatttgggtgtaaaaattgaagacaatggtgatattgttgaagtacacggtgttggctttgatggtcttcaagcccccaaaaatgatttggatatgggaaattctggaacctcgattcgtttgatttcaggcgttttagcaggtcaagactttgaggcgactatgtttggtgatgattccttatccaaacgtcctatggaccgagtaactattccactcagtcaaatgggagtagagatttctggacaaactgaacgtgacctacctccgttgaccatcaaagggaataagaatttaaaaccaattcgctaccaactccctgtagcctctgctcaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcataccaggttcaaaaattgtccttgaaaatgtgggaatcaatgaaactcggactggtattttagatgtcattaaagctatgggtggtaaaatgactctttctaacatagatgaacttgcaaaatctgctaccattacagttgaaacgtcggaattgaaggctacggagattgcaggcgaattgattcctcggttgattgatgagttgccgattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaaggattgctggacttacctagtaattgtatcgtatcaactggtggtggtgtgattaaatctgaagtaaacagggaattgctgttggcaaatagggaggacaatgtacttcttactgcctcctttgaagtttcctatcagagaattcgtaaggatagacagtcgcaaagacctctctttttacagtgtagtaaggaagagtttgaagccctctatcgtgaacgaatggcactttatcaaggtttagccgatactgtaatcgatacagataaactgattccagaacaagtagcaaggaaaattttatgcaagtagcctatctaggacctcgtggttcttttacacatcaagtggcccagcaggtctttccgactgcggatttgcaggcttttgagacgattacagaggttatcaaggcctacgaaacgggggaagttacctattccgttattccagtagaaaactcgattgaaggtagtgttcatgaaacgattgactacctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagttagtacagcctatgctgctcgctttgtggcagaacaccctgaacaaccatttgcggcaattgctccgcaagcggcagcagttgaatatggactggaagtaattgcgcaagacatccaggaaatcagcgagaattttacacgcttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccgacccctgaaaacggctttgggtgagtattttttcatactggatcttgacaatcagtctgaggaattattaacctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggattatctattatataaaaaagagctgagagaacggcatggaagtccaaggcaatctctacgtagcttcacaccaacggcttatgaagatgactacttcgaggaagattattttgaagaggatgatgagcaagaggaactgttgcctcgctatcctgaacgtaaatccagaaaaacaagacaagccaaacctcaacggtttcagtctcctcgtatcggtcccaaagcgaaagtacctaaacctaaaaaagctcgtaaaaagggtggtttcaagcgctttattggtttcgtattgcttgctatagcgctagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggcgaaagctcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaatagttttgacattgatatcaagtactatgcgatggtggattttgcaacctttgcgacaacgattgatacacttttccctgagggcgtaacgattgatgcacagttttcaactattaatggtgaagtcgttagctcagtagaagtgccgaatgatttacagctggaagaaaatgctcctgcttatcaaacgattcaggtcggtgtacagcagatggatggtaagaccttgcttaactacgcgcgctatcgttcggatgatgaaggtgattttggtcgtacgagacgtcaacaggaagtgctatctgctgttatgacacaggctaaaaatccaatgaaactattctctggctccgaagctataggtaaggttgtggccatgactccgacaacagtaccgcaaagctttatgtggctacagggaccaggccttctattggatgcggcaaatggtatcgaacgtgttacaatcccagaaaatggagactggattgacgactatgatatgtatggtggtatggctcttcgtgttgattttgaaaaataccagcagcgcttggctgagttaggcctgcgttaagaaatatggtatactagaagtgacttcggtcactttttagtggtccaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcacaagaccgtaatcaggacttggattttacctatctaagaacaggtattgctgacttggggcatctcacttatccagcccaactagcttttaagaaaaaacaagttgagaatagtctacgtaagattgcaggcatttcagaaatagcagtagcagatacgttgggaatggacagtcctcttgcttatcgtaataaggcagctgttccagttcgtcgtgtgaatgggcagttagaaacaggattcttccgaaaaaattcacatgatttagttccgattgaggatttttacattcaacacaaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaagattttccgtgttgaaacccttattgagcgtttgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaaaggctgtccttgatagtcagaagaatgctgctcgaaatgggattgataatgttacttatgtctgtgatagcgctgaatccgctatgcaaaaatgggtggcagatggagtcaaaccaactgtgatttttgtcgacccaccacgaaaaggtttgacagaaagttttatcaaagcaagtacttctgtaaaaccagagaaaatcgtctatatctcttgtaatgtggcaaccatggcgcgtgatattaaactttatgaggaattggggtacaaattgacgaaggtacagccggctgatttatttccaaatacgcatcacatagaagttgtgggattattagaaaaacgcaattagattgtccagtatgctctcctgttttttggcaagcagcttcaaaggaccccaggacctttgaactctcaaatacgcatcatgttgacagttgccacacctacaccaaaatcaaatgccaacaagcgttgagtcgggtaatagcgtaagtagcgcaaggtcatgataagctgctcttccatacttagacggcgtgggcgtcctccttttcggtgttgctcttgataagcgtcagtgagacaatcaagcatcagatgaaacgtcgcttttttacacctatcaacaatttgaaattctctgagtttaattttaagactttttcgtatgttgtttccatacctttagtataccgcctttgagttaccgaacaagtctattgctaaacttgatgaaggttgtattgtctgttataatattggatattgcaagctttaagtgaaaggttttagggaagagattatcacaactcattctttattagttatgagacgatggtattaatgatagtctagtaaaagatttggagaaatgacttccttagaaagttaaatgtaaaaacaatatgaaaaaatacgattatctagttgtcggagcgggtctgttcggagcggtctttgctcatgaggcagctaaaaagggtaaaaaaataaaggttatcgaaaaacgagaccacattgcgggtaacatctatacaaaagaagtagaaggtattcaagtccatgaatatggcgcacatattttccatacttctgaaaaagaaatttgggattatgtgaatcagtttgcggagttcaacagctatacaaacacaccagtcgccaactacaaaggtgagatttacaatcttcccttcaacatgaatactttcaataaactgtggggcgtggtgacacctgctgaagcaggagcgaagattgcagagcaacgagctgtgttgggtggtaaaacgcctgaaaacttggaagagcaagccatctcacttgttggtacagacatctatgaaaaattgatcaagtcctacacagaaaaacaatgggaaaaaccatgtacggagttaccagccttcatcatccgtcgtttgcccgtgcgtttgacttatgataataactactttaacgatacttatcaaggtattccaatcggcggttacacgcagattgtagaaaaaatgttggaacatgaaaatatcgatgtggagacaaatgttgatttctttgccaataaggaagactatttagctacctatccaaagattgtctttacaggaatgattgacgagttctttgattaccaacttggtgaattggagtaccgtagccttcgatttgagacagaagtgttggatatggaaaactatcaagggaatgcggttgtcaactatacagatagcgagacaccatatactcgaatcatcgaacacaaacacttcgaatttggtacacaaccgaaaaccattattacacgtgagtattcgaagacctggaaacgaggcgatgagccatactatccagtcaacaataatcgcaataaccatctatacacagcatataagaaattgtcagaacaacaagagaatgtcatattcggtgggcgtcttggtcattatcgttactacgatatgcaccaagtcatcggagctgccttacagtgtgtgagaaatgaagttggggaatgattttgagaagtcatcaaagtagtaattattcttggcagaagtcggaatgctcttaaaatgttaatcaaaaaaaccagaaattctggttttttttgattattattgaattgctgccaacaggtcagctacttgttgttcgagttttgttagagtttcgtcagataactccaatacacctgttccccatgcttctggattgatggttgaacctgtaaattcaccagcaatctgagtgcgaataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagtcaagaatgcttcagctttttttgccatttgatggttaaaagaaccgtcacgtagtgaaccaactaaaaacaatacgtttgccatgatggcctccttttcataaaaacataaatttagtatatcgtatttgtcttttgttgacaatcctaggtctgctgattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttctttataacgacagtcatgttgccagaagtgcttaataatttatcaattaagtcttgaatccgcagatttcctttgttgtagagtgcctccatcactccaaactgacaaactgtcagtccgtattttttgattgtttctaattctgattttgcgatagtattagctgctctgcgaaagacgactagactgtgaagtgcatgcttgttctcgtttaaagattgttcaacagttctcatgagaatattttagcaataaatcgttcggttatcaagcaaaaaaagttaaatcctatattcataggtaaagtacttttatggaaaagatagtttttagttaatcaagttcgttttttgaggtaatactaactgtactggaaaaaacgagcaatgagcatttgagaaatagtcttagatggaagtgcaaaactgtgaatgtaggtttttatatccttttctttgtgtgaaggaaaaggaaattttatttatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatacaatcacagaaagaatggaaatatgctttaatttgtagtataatgggactgttatggaaaaaaagatttttcaactgttggagtggatggcttccaagactggtcagttagtgatgggctcttttatccttctcagtgttgtgactttttcaatttttactatttgggatattgctgctgcccctttcaacaatgcgcgtagtcatgcagttggagtagctacagaatatgctgatttgcaaactgtcaatgatttttctatctacaatggtactgaaacctatttttgtgtatttggtgtcaccagtcagggagaagaggttgcagttttgattccagaggcttctagcacagtatatgtctattctttagctcagggaatttcgcaagaagaagcgcaagctattgccaagaaaaacggtgcaagccaagtagagcgaactattctaggtttaagggatggcaaacctatttgggaagtcaagtcaggtactgcctactatttagttgaatttgaaacagggaactttatcaaacgggagggcttatgagcaagctatcaaaacgtgtcttagaaatggaagaaagtgtcacgctggcagcgggtgcacgggcaaaggccttgaaggcagaaggacgtgatattttagagctgaccttgggtgagccagacttcgttacaccgaaaaatattcaagaagctgctattaagtctatcgaagatggtaaggcgagtttttatacggtagcttcaggtctgccagaattgaaggacgcggtcaatacctactttgagaacttttatggctactctatcgaacgcaatcaagtcgttcttgccactggtgccaagtttatcctttatgctttctttgcggcggtcatcaatcctggtgatgaggttctgattcccacaccttactgggtttcttatgcagatcaaatcaagatgaatgatggggtgcctgtctttgtcactgcaagtgaagagcacaatttcaaggtaacagttgaccagctggaagcagctcggacagataagaccaaagtattcctactcaatactccttctaatccgactggcatgatttacagtcgtgaggaattggaagctattggcaactgggctgtagagcacgacattctcatcttggcagacgatatttacggtcgtttggtatataatggaaataccttcacaccgatttcaagcatttcagaaagcattcgtcagcagactattgttgtcaatggggtggccaaggcctatgccatgacaggttggcgggttggatttgccgttggtaatcctgagatcattgcggctatgagtaagattgtcggacaaacgacgtcaaacttaacaaccgctgctcagtatgcggccattgaagcctttacaggtccgcaagatacggtcgaaaccatgcgtcaggcatttgaagagcgactcaataccatttatcccttgctggcagaagtgcctggttttgaagtgattaagccagaaggtgccttctatctcttcccaaatgtcaaaaaggctatggaaatgaagggctacacagatgtaactgaatttaccacagccattttggaagaagtgggagttgcaatggtgacaggtgctggttttggagctcctgagaatatccgcctcagctatgcgacagatatggacacgctcaaagaagcagtggctcgactacacacatttatgaaaaaataaaaagaggaaaaataatgtctagaaaattgattaccatcaaccaagtaaaagattatgtcggtcaagaagtgaccattggtgcctgggttgctaacaaatcaggcaagggcaagttagccttcctgcaattgcgtgacggaacagccttcttccaagcagttgccttcaaaccaaacttcatcgaaaaattcggtgaagaagctggtactgagaagtttgatgtagcaaaacgccttagccaagaaacgtctgtctatgtgacagggattgtcaaggaagatgagcgttctaagtttggttatgagttggatgtgacagaccttgaagtgattggtgagtcacaagattacccaatcacaccaaaagaacacggtacggacttccttatggacaaccgtcacctctggttgcgttctcgtaaacaggtcgctatccagcaaatccgtaacgccatcatctatgcgacttatgaattctttgaaaagaatggctttatcaagtttgatagcccaatcttgtctggaaatgcggcagaagattcgacagaattgtttgaaacagactactttggtcagcttgcctacctcagccaatctggtcagctttacctggaagctggtgccatggcccttggtcgtgttttcgacttcggtcctgttttccgtgcggaaaaatcaaaaactcgccgtcacttgacggagttctggatgatggatgccgagtattcattcctcagccatgaagagtcacttgacttgcaagaagcttatgtcaaagccttgattcaaggtgttatcgaccgtgctccacaagccttggaaactcttgagcgtgatgtggatgctctcaaacgctacattgcagagccattcaaacgtgtggcttatgatgatgctattacccttcttcaagagcatgaagctgataaagatacagactacgaacacatcgagcatggtgatgactttggatcaccacatgaaacttggatttcaaactactttggtgtaccgactttcgttgttaactatccagcaagcttcaaggccttctacatgaagccagttccaggtaatccagagcgcgtgctttgtgcggacctcttggcaccagaaggctatggtgaaatcattggtggttctatgcgtgaggataactacgatgccttggtagccaagatggacgagctcggtatggacaagtcagagtacgaattttaccttgaccttcgtaaatacggttcagtgccacacggtggtttcggtatcggtattgagcgtatggtaaccttcgttgctggtacaaaacacatccgtgaagccattccattcccacgtatgttgcaccgcttgcatccgtaatacagtcgttcagtttttcctttattacgtcg

SEQ ID NO: 36 - DNA, 24248 bp, Streptococcus suis
attacaggtgggttatcgggtagttttaatgcggcacgagtagctagggatatgtatatcgaagagcatccgaatgtcaatatccatttgatagatagtttgtcagccagtggggaaatggatttacttgttgacgaaatcaatcgcttaattggtgcaggactagatttttcacaagtagtagaagcaataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagtgagagagctttttgcatgataagattggtatcgtagtcgattagactcttatgtttgatgaaggtatcacgtagctggttaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagatagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagccggggcgcgagaccaaaaagcaatttgatgtaaaaaagatggctgctttttataaattgaatgaagaaaaggctgagttagaagctgaccgttggtatcgaatcaggacaggtcaagcaaaaacttatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgcttagattttcaagggagcttaaagatagacaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagttatgaacaagattgaacaagataacgtttttcatcactaaatatggctatgtggctagtaaaatattgttttttgtgatacaatagatgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcacttgtcatcacttctgtcggaatctatggaatgcaagaagttgtaaaattttcaacacgactaaattcaaattcggcattttcagaatatgaaatgagcatcctcgtcccagtaaatagtgagattacagatgttcgacaggtcactaatgtacttgctccggctgaatacgatcaagacaacatcactgctttattaaatgatatttccaaaatggagtctactcaattaactacaagtccgacgacctcttatctaacagcctaccaagctatgctaaatggcgagagtcaagcgatggtcttcaacggagtttttaccaatattttagaaaatgaagattcagacttttctccaaaagtgaaaaaaatatatagtttcaaagtgactcagactgttgaaacagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacattgctattgcagatggtgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgaggtcaccagataatctagcgaattatcaagctattctaactggtttggaaggatctatccaaacagatttgagcttagaaacgattatgggcttggtaaatacccaattagaatcaggaacacaatttacagtagagtcacaagcagtgacaggaacaggacgctcagatttatcttcttatgcgatacctggttcacaactttatatgatggaaattaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaaatcttcattctagtaactgcggtattaggagcagggctggcatttgtttatagcagttttttggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggcgcaaaagattgttgaggtcactaaggtaagcgatgtgacaacacttgaagaagcagtcccagcggaggaaccaaccactccaaatacaaaacgaaatatcatacttggcttattagctggtggtatcttggcaacaggtcttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtaagaaaaaagaattggtaaataagactgaagaatatttcaatgccatccgtaccaatattcagcttagcggagcggatattaaggttgtaggcattacctctgttcaatcgaatgaaggtaagagtacaactgcggctagtctcgctcttgcctatgctcgttcaggttataagaccgttttggtggatgcagatatccgaaattcagtcgtgtctggtttcttcaagccaatgacaaagattacaggcttgacggattacctagcagggacaacagacttgtctcagggattatgcgatactgatattccaaacttgaccgccattgagtcaggaaaggtttcacctaaccctactgcccttttacaaagtaagaattttgaaaatttacttgcgactcttcgtcgctattatgattgtgttatcgttgactgtccaccattaggactggtaattgatgcagctatcattgcacagaaatgtgatgcgatggtgctggtagcagaagcaggcaatgttaagcgctcatctttgaaaaaagtaaaagagcagttggatcaaacaggcacaccgttcttaggcgttatcttgaacaaatatgatattgccaccgagaagtatggtgaatacggaaactacggaaattacggcaaaaaagcttaatttctcagataatataagtttgataagtaggtattagtatgattgatattcattcgcatatcatatttggtgtagatgacggccccaaaactattgaagaaagtctgagtttgataggcgaagcttatcgtcaaggtgttcgctatatcgtggcgacatctcatagacgaaaagggatgtttgaaacaccagaaaaagtcatcatggctaactttcttcaacttaaggaagcagtagcagaagtttatcctgaaatacgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgatgctacttgggctaactcccgtacttgctcatatagaacgatatgataccctagcgtttcatgcagagagagtagaagagttaattgacaagggatgctatactcaggtaaatagtaaccatgtgctgaagcccgctttaattggtgatcgagcaaaagaatttaaaaaacgtactcggtactttttagagcaggatttagtacattgtgttgctagtgatatgcataatttatctagtagacctccgtttatgagggaggcttataagttaataacagaggaatttggcaaagataaagcgaaagcgttgctgaaaaagaatcctcttatgctattaaaaaaccaggcgatttaaactggttactctagattgtggagagaaaaatggatttagaaactgttaccgataaacttttagagcgcaacattaaacgattgatactcatgtgcatggatacgtgtcttattatagtttccatgattttgagcaggctgtttttggatgttattattgacattccagatgaacgctttatttttgcagttttatttgttttaatattctacctgattatctcagttagactaaaggttttttcgctaattacgaggtatactggatatcaaagttatgtgaaaataggactgagtttgatatccgtttattcattatttttaatcatttcaatgattctatggcagacctttagttatcgtttcatcttagtatccttatttttgtcgtatgtaatgctcattactccgaggattgtttggaaagtcttacatgagacgagaaaaaatgccattcgaaagaaggataacccactaagaatcttagtagtaggtgctggagatggtgggaatatttttatcaataccgtcgaagatagaaaattgaattttgaaattgtcggtatagttgatcgtgatccaaataaacttggaacatttatccgtaccgctaaagttttaggaaaccgtaatgatattccacgattggtagagaaattagctgttgaccaagtggtgattgccatcccttctttaaatagtaaggagcgagagaagattgttgaaatctgtaacactacaggagtgaccgtcaataatatgccgagcattgaagacattatggcgggtaacatgtctgtcagtgcctttcaggaaattgacgtagcagaccttcttggtcgactagaggttgttttggatcaggatgaattgaatcagtttttcaaagggaaaactatccttgtcacaggagcaggtggctcaatcggttcagagttatgtcgtcaaattgctaagtttacgcctaaatgcttgttgttgcttggtcatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttccattgatggaatataatccacatgaagcagtgaagaataatatttttggaacgaagaatgtggctgaggcggctaaaactgcaaaggttgccaaatttgttatggtttcaacagataaagctgttaatccgccaaatgtcatgggagcgactaaacgtgttgcagaaatgattgtaacaggtttaaacgagccaggtcagactcaatttgctgcagtccgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatctttgtcttggatatgggcgagccagtacaaatcctggaattggcaagaaaagttattctgctgagtggtcatactgaggaagaaattggaattgttgaatcaggtattcgtcctggggaaaaactctacgaggaattactatcaacagaagaacgtatcagcgaacagatttatgaaaaaatatttgtaggtcgcgttacaaataaacaatcggacattgtcaattcatttatcaatggattactcaaaaaagatagaaatgaattaaaagataagttgattgaatttgcaaaacaagaataagaaagtaaaaaaatatttttactttcctagagtttaaacgatgtttaggttctaggatggttgaaatactttcctgaggtaagatatgctaggtcataggttagtaagagaaaaagaaaataggatcaaaggtggtctttaccataagattcaaatcgagctggctttcaactcaaaccacattgaaggcagtcaactgacgtatgaccagacaaggtatatctatgagaccaatacgattggttttgaagaaaattcaaccataaaggtggatgatattatcgaaacgaccaatcattttacggcttttgattttctcttagatagctttcaagatgatttgaatgaaacttggctaaaggagattcatgctatcttgaagagaggcacctctgattctcggaagtcatggtttcaagtcggagactataagtcgtacccaaatgaagttggcggatgtgaaacgactctacccgagtatgtggagtcagacatgcaagaattgcttagaaattatcatgctctatcacctacttcctttgaggatattcttgactttcatgttcgatttgaacgcatccatcccttccaagatggtaacgggcgagtaggtcgattgattatgtttaaagaatgtctcaaacatgtacatgtcccctttatcatcggagataacatgaagtatttttactatcgtggcttagccgagtggggagagcagaatggtttcttgctggatacttgtctagcagcacaagatagatttaagcagtatttggagtattttaggattgagtaaatatacgtaatagaaggagaatagataaaatggcatttgattttacacaaaatttaaccccttttgagaacaaggtatggcttgcctctcccactatgcatggtgatgagttagagtacatgaaggaagcctatgataccaattggatgacaacggctggttcaaatatcaatgctctagaagaaatgataaaggaatacaccaaaagtgagcaagtagttgcactttcgtcagggacgtctgctttacatttagctatgaagttggcgggaataaagagaggtgactatgttttttgctcagatgttactttttctgccactgcgaaccctataacatatgagggtggaatcccagtgtttattgattcggaatatgaaacatggaatatggatccggatgcattggagaaagcatttgaaatttatccggatgtaaaagttgttgtgttggttcacttgtatggagtacctgcaagaattgatgaaattcgagcaatatgtgatagacatggtgcacttcttatcgaagatgcagcggagtccttgggggcgacctataaaggacagcaaacaggaacctttggacaacattctattatttccttcaacggtaataaaattattacaggttcaagtggtggagctttattgaccagcgatttgcaagcagcaaataaggttagaaaatggtcgacacaagctcgtgagcaggctacttggtaccaacatgaagagattggctacaattatcgaatgagcaacgttattgcaggtgtggtacgtgggcaaatgccttatttagacgagcatattgcccagaaaaaagccatttacgaacgttaccaagaaggattgaagggattgccaatcaaaatgaatccatttgattcaactaattcagtaccgaattattggttatcttgtttaactataaatccagaagctatggcaaagcaagtacgttctgataatgatgttctttatacttctgagaagggaaaaactactccttctgaaattttagatgccttgaacacaattaatgcagaaggccgcccaatttggaagccaatgcactcacaaccaatttttagaatgaatccatttattacaaagaatggaaatggtagagctcaaaccaatgcatatattgtgggaaactactcagatgtcggtacagatctttttgaacgtggcttatgtctccctagtgataataaaatgactgtagagcagcaggatattattattaaaatcataagagcttgctttgaatagaaattaggaaaaatgaataaaggattatacgaaaaatattttaaacgtttgatagattttactttatctttaatagcgattattttgctatctccggtcattattctggtcagtgttttagtatattttaaattaggttcaccagtcttgtttaaacaagaacgccctggaaagaatgaaaaaatttttaaaatgtataaatttcgaactatgacagatgaaaaagatgaaaagggggaacttttacccgatagtgttcgacttacggcatttgggaaatggctccgttcaacaagtctagatgaacttcctgagctctttaatatattgaagggagatatgagtatagtaggtccaaggcctttactgtccaaatacttaccgctatactctgaagagcaagctagaagacatgaggttagacctggattgacaggctatgctcaagctaatggtcgaaattctttaaattgggaagaaaaatttgtgatggatgttgaatatgtagataatatttcattcaaaggcgatgtaaaaattatttttcaaacggtcatagctgtgttcaagagaagcggaatatcatcagctgaatctgtaacaatggaagaatttaaaggaaacaaatgaaaaaacttgctattattggagctagtggtcatggtaaagtagttgctgatattgctgaaaaaaatggctacaaagaaattgtatttttagatgatcattctactggtgaatgcgcaggctatccgattgttggtacgtcacaatgcattgaagaattgaccgactttgaattcattatagctattggaaataacaaaattagagctagtaaacaatgtttgttgcctcaggatagaattgcgactttgattcatccctcagctgtaatttcaagacgtgttgttgttaatgctgggacagttattatggcaggcgcagttgtaaattctgatgtaacaatagggagaggttcaataataaatacagcctcttcggtagatcatgattgtataattggggattttgtacatgtttctgttggagcacatgtagcaggtacagtaagcgttagtgattacgcatggattggagcaggggctgttgttagtaataatatccaaatagggaatgatgtgtttattggtacaggctctgtagttattaaggatattttaagaaacggaatttatgttggtaacccagcacgcttgttacgggaacaataaaaatggagtgattatttgatatatttaatgaaaataatattttggcttagtatctttttaattttttgggcaaatattggttatcctgcttcaatgatatttttggataaaatcattaaaaagactaatgaaaagctaacggattatgaaccgactgttactgtaatggtcgttgcacacaacgaagaaggtgtgattgcagataaattaatgaatctccttcagttggactatccaaaagataagttcaatattttagtgacttcggataatagtacagatagaacaaatgaaatagtgaatgaatttgtattgaaataccaacagatatacctatatcaagttgaaaaaagacagggaaaaacgaatgcacaaaatgaagcatcaaaacttgtcaagagcgaaatattagtcatgacagatgcaaatgcaatgcttaaacatgatgcaattaacgaacttgtaagttcattcacaaataatgttgcgtatgttaccggaaaattagattatataaatcaaaatgaaagtcttacaagcaaatccgagagtacttattgggacttagatactcgaattagagatatagaatctagatttcagacgatcacagctggaaatggtgcaatttatgctgttcgtactgaagactatgttgattttgacccaataatgagtcacgattcagcaatgccattatattttaatttattgggtaagcgtgcggtagctaatcataaggcaatcgcatatgaaaaggccggagaaaatgatggcgatgaatttaaaagaaaaatcagaatggcaagaattacactgcattttattctgccatcgattaaaattttgaatgtttttaaatacaagtggtttacttatttttatttaggtcatagaactgttcgttaccttctctggtttaatcatattattttattcatagcaagtgtagttttaatgtctgagaattcgcattattggttaccttgtgttggacaattaataatttatttgattgctagtatgaaatatttattttcgatagacattaaaataataaactttatagcatactattgtatgacagttacggcgcaacttattggtgttttaaaaactattttagggagaaacaaaccattttgggagaaggcagaaagtacgagatagttggataagatgacaaaaaataatagaatcgcttttttaaatgatgtattacttaattcattatcttttttcatttacatattagggcaacaattgttatttatgccattgatgggtaaatggttgactgaaggaatatatgcaaactttattatatttatttctgttttcgcaatactatcaaatagtttgggaaatgagttaggtatagtgagtcagattattgaacaaaaagtgaattttcaaaaaattcttcactttattgcttttatttctttttgtgttacagtgataattctgtattatcttaattttaattttttggatactgttcttttgtctttaagtgtttttttagcaaattatagactattctattccggctattttaggaaaaattctttatttagaaatgttttagttattaatattttatatttaattggaatctgttttggtttggcagtgtatagattaacataccttatttggtcacctttgcttttagcagaacttatttcattgatttatattttttgttatcaaaataaattggaagaagataatataccaatttctaaagaaaatgttaaaacatttttaaattttagcttaatatcttttctgaataatctaatcacctatcttgataaaataatcatttatccaatattaggaccgacagcagtaagcatatactattccactgcttctatgtccaaagttgtaaatttagttactaaccctttgcatggagttttactgaattggataaaaaatgatggaaatagaaataatattataaagaaatttattgttgcaaccatgccaattattgtaataagtagtatcatttctataccaattacttattttgctatgaaactactgtattcacagtttttgccccaaggaaatcaattgattgtaccagtatctttagctttaggaattagtattggaacttcattgttgaaatctgttttactaaagtttattgatagtaaaattgttcttagaatatttatattttattttctatcttttgttatattggcatatgtttctagtaatttatttggattagtgggctttagttattctgtatttatctcaaaatgtattttgttaattgggtttatatctccacttataaagcttaaggaggctaagggttgaaaaatattactgatactttagtaaaaattatttatttaaacataattccttcggctcttctgggggtttttcaaatcagcagcacgatctatacagccttattcgcacttgtttttgctttccaaatatttttaatatctagaacactgggaagaaattcaatctatttatctaggaatcaaatgtatgttttaatattgatttttgctattcaaattatttcaaatctttatagtgcagcaatttatgataattttaatttgaatgaaactcttgttatattttcagtgactttgaatatttattattttataatatgtttattcaatgttaatattgatatgaatcaattatatagttttttttataaagtgatttgtataggaatttttgcatgcattgttaactttttgttaaattttcatgaattactatcagtttctgctataactagtgcatattctgttagttttagttcattttttgctaatagaaatacgtttggcattttaatgctaatatccattatttctaataaatatttaattgagtccagacattatagatttgccaagtatatccaaatactattttttattaatatacttttgactttatctaggacatccattgcaggagtagtagttttttattttgcttattatcttattaatatttttgggaaaaacagtagtttcaatattaataaggttttgattggtctagttggtatttgtttaggaactttttctctatatttattgatcactaatcaagctttaatagaccgaataaccattttgtttatcagaacgaagaattttggaactgcagcaggtaggactgatgtttggaaaaatggaattgagattggtttgaataataatttttggtttggtttaggtagatatcgagctttagagttaaatctagaattatatcagaatactttgccttattttcattccatatatgttgaaacatttgttacatatggttttttgggtctttctattttgatctcatatttttgtaacatattatcaaaaactgctaaatcttcctttattcataaaaaaattacattagcatcattaatttgtttttttgttatctctatatttgaatctacaacgagattttcaataggatatgcagatactatttcattgattttctttttttcaattccaatattaattggtaatttgcatgattaactatcggattttctaaaaagtatttattttgggatgttatcacctgtagtgggttgtctctttaaaattgggagaggacagagattgtcttctctcgttttatattaatggtaaccgcccaataacaaggtatatcgaaaaaggctccaaagtcctgtcgactctggaacgctgatacttctgatttggagagagattttggttttagcccctctaccacactcagagaaggcttacgccaatttgctcaatggtataaagagtattacaaatagttttattttgctattggggcgatagccttttggacaaatgccataatttgtgtcaggattagtaagaaaagactaataataaagttcactgctaataaggaggttttatgtatagtaagtatgaaattactcacgtagcatgtgatagaaaacaggatgtaaagacagtttataatgagtacaaggctaataagcaacaattcatcaacaaaattgcaaattgtgttaaagatgacgtattaaagacttattatagtcggattattcatgattatgatgagaaaatttacattgattctgtagagagagttttaaagaatcgagaattagtatctcaaaataaagataagattttaaaaacattgaaattttatgacaaaagaaatctgtctgattgtgagtttttaaatgagagtaatgtagaagtatatctaaactcccttcatgttaacaatgacaggcttgctttctacttaaaacagttaaatggtgattataatgatgcttaagttgtatatttgattttactttctttttgataacaattattttgattttttttgtaacaaatggtatactttgtatatcatttttttgatgaggtgaaattatgagtaacaaagaattttctcaagaatttcttaaaactattattttttctaaaagaaaagagttaggatattctcagcaggaactttctgatttgacaggaataaatagggctatgattagcaagttggagcaaggggagtatcttccgtcaattccgcaattactttctctgagcaatgtgcttgattttgaaataaacagtttatttgtttctgattttccgaagtcaatcggcactcttccggcaaaaaaaatcgctgtcgcaggaacaggctatgttggtctatctatcgctgttttactagctcagcatcatcaactcacagctgtggatattatccaagaaaaagttgatttaatcaatgcaaagaagtcccctattcaagatgattatatagagaaatatctagcagagaaggatctcaatttagtagcaacacttgatgcagaaacagcctacagagaggcagaaattgttgtgattgctgctccaactaattatgatagtgctaagaattacttcgatacaagtcatgtggaagccgttatacaggcagtattatcggtcaaccctcaagctttaatggttatcaaatcaacgattcctgttggttttacccaatctatgcgagaaaaatttggtacagaaaatattatttttagtcctgaatttctgagagagtcaaaagcactttatgacaatctttatccatcacggattattgtatcttgtgaagatggtgcgccagattcggtagtagaaggttcaaagttatttgcttctcttctacaagaaggagccttgaagaaagatgtggaagtgttgcatatgggatctacagaggcagaggcagtcaagctttttgccaatacctatttagccttgcgcgtttcctacttcaatgaattggatacttatgcggagctaaaaggattagatacagaatcgattattcgaggagttggtttggatcctcgtatcggtgatcattataataatccctctttcggatatgggggttattgcttgccaaaagatacaaagcagttattggctaattacaatgatattccgcagaacatgatgacagccattgtagagtcaaataggactcgtaaggattttattgctgatcaaattttgaagatagctggttattatgattattcgtcacatgatcaatattctcaatcgggagaaaaagaagtgatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacacctagagaggacgaaattcgttctctcatttttgatgtttaaagcaatatatatctttgttttaaagttcgtaaagttcctaaagccgaacgcttgcctcttgatgtctttgatgagtttattggtcgcttccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgccagtgatttttcatggatcgataaggtagggaacgcgtatcgaaagtcttcataatatcaattctagtcgtcatcatagcacggctcaggtgttggataatgtgaaatctatcaaggacaattttagctcttggaaatagttttttggtgatgggaatatagctacccgacatgtccactgttacgacctcgacagtttctctgaccgccctaggatacttgtagaaatagttcttgatggtggtttggcggttgttgtcaagaatggtcacaatcgatctcgtctcaaaattctgagcaataaaggcgagttttcccttgttctgactaaattcatcccagctcaagacttttggtaatttcgtaaaatcatgctccaattgaaactgagccagtttcctctggacgaccgatacggagatatgtaatctcctagcgatggctatattggtcatgttttctgtatggagttgtgtcactttctcccaaataggtagggaaatctgacagtttttcttgactagagctgtctcagttacagtcactttttggcaagatttgcattgaaaccggcgttttttaagcaagaggagggtcggaaagccctggcaatccaaaatcggaatctttgacgacttttgaaagtcgtacttgatacactttccttggcaatgaggacaacgagggctgtcgtaatctagctttgccctgatttctagatgggtctgatgtttcaaaatgaagagaattttgatgtttttgtctttgattccaattagttctgtggtatgatcttcgcttttttatttctaggctcaggaatccagagtcacttccctgactctggatttattccatatgagtctttctaatgtgagtgtggttgcttttcattataggttatatgggactttttgtatatattcaaaaaggctccataatctctacagtggatttacccactacagaaattatagagccgaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaccaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcctcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattcccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttgggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacacttggttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagatgttttatgtattacggtcgcgatactgaaatagaagaattaaaacagcattttaaattttccagtaatgataaaaatagtttatatattattaatggcttaagtggtagtggtaaaaccgagttaatcaaagaggtttgtcaataagtttacagtcatgataaagaagcgtttattctctacattgatgttacaaatgacgggtttgaaagtaataaattttttgaaaatctactaaaaggagcgtatgtcccaactcaattcagaagaaatctatgcttatcaatacctcaaaaatattcattttcaaattatttaagaaaacaaaaactaacaaatctaactctgaaacatagttttaggttaatcagatctttgatttcattcgatacaacctataaaaaagtaattgattatccttgggaagaagttgttactgaaataaaggagggaatatttgaaagtgatttatatttaagatatttcagtcatgtttcaaaaaaaatccgtctgaatattattattgataattatcaatttttatctgaagatataaaaataaaatttgaagatgactttaatacacttcaaagcggagtctccttaactattataaaccgaacaactgataagttaaaatcaattgataaactagatacattggacaattatactcctactgtattaaatttatcgtatcttactgaggatgagtgtaaattactaataagaaataaaattgctttacttgataatatcaaattgaatcaaatctggcagataacacaaggtaactataaagagattgaattgattattaacagacttattgataatccaaattcagaattatttaataactcgtggtgctagttcatttcaaaatacaataaaaagcccaaaagagccacttacagtataccgctaaatctcatcatttgcaatggaatgtatgccaattatcacaaatttgtcatcacttctaccacaactattgcccggattccttcaaatatcggcgtaatgttggcttagttaaagtttcagatgaatcaatccttgtcttacttttgttacaagctgaactaggtatgacatcacagcgccatttctacaccatctgccacctcttcccttgcggtcagttactagaaagaagccgtttcaatcgtcggtcaaaacaattgatttggctcgtccaattaatccgaaaagctatgagtgaaatgcttccatctgataaactagccattatagatagttttcctgtgccactttgccaacctgttcgcaatcacagagctaccatttttaaaggattagccgatattggctacaacgcctctaaacatctttggttctacggtttcaaggttcatatgctagtgaccttatcaggttatattctgaactatgttgtcacacctgcctctgttcacgacatcaaggtggtttatgaactattagaagggtgtaagcaatcggttatcctaggtgatttaggctacctgagcagtgagctcaaaaagtacttagagcaagaaggttaccatctatggatgccgtttcgtaaaaacatgacaggggccgaagaacataacaattggaaagtaatggccatgagacgaactattgaaactcgtttttctgaactgtgtcgtctctttgacatcgaacatacattagctagaagcctagccggactacagttacgaatggaacaaattattctagctcataacttacgctattttgaaatgaactagcaccacgggtatcattagtataccataatctacatttgttttatagattttattaaaatttttatagtaaatatttttagttttttgtttcaaaaatgtaatggagattgatttttcacaagtaattgtcataaaaatcagaaaatattttataaatatgataaaataaaagtgatactagtttgaggtaaggatatgaaattaagaagaagcgtagaaaaactacagggaac

SEQ ID NO: 37 - DNA, 26593 bp, Streptococcus suis
attacaggtgggctatctggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagtgagagagctttttgcatgataagattggtatcgtagtcgattagactcttatgtttgatgaaggtatcacgtagctggttaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagatagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagcagcggctgcaggacaaaaagcaatttgaggtaaaaaagatggctgctttttataaattgaatgaagaaaaggctgagttagaagctgaccgttggtatcgaatcaggacaggtcaagcaaaaacttatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgcttagattttcaagggagcttaaagatagacaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagttatgaacaagattgaacaagataacgtttttcatcactaaatatggctatgtggctagtagaatattgttttttgtgatacaataggtgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcacttgtcatcacttctgtcggaatctatggaatgcaagaagttgtaaaattttcaacacgactaaattcaaattcggcattttcagaatatgaaatgagcatcctcgtcccagtaaatagtgagattacagatgttcgacaggtcactaatgtacttgctccggctgaatacgatcaagacaacatcactgctttattaaatgatatttccaaaatggagtctactcaattaactacaagtccgacgacctcttatctaacagcctaccaagctatgctaaatggcgagagtcaagcgatggtcttcaacggagtttttaccaatattttagaaaatgaagattcagacttttctccaaaagtgaaaaaaatatatagtttcaaagtgactcagactgttgaaacagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacattgctattgcagatggtgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgaggtcaccagataatctagcgaattatcaagctattctaactggtttggaaggatctatccaaacagatttgagcttagaaacgattatgggcttggtaaatacccaattagaatcaggaacacaatttacagtagagtcacaagcagtgacaggaacaggacgctcagatttatcttcttatgcgatacctggttcacaactttatatgatggaaattaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaaatcttcattctagtaactgcggtattaggagcagggctggcatttgtttatagcagttttttggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggtgcaaaagattgttgaggtcactaaggtaagcgatgtgacaacacttgaagaagcagtcccagcggaggaaccaaccactccaaatacaaaacgaaatatcatacttggcttattagctggtggtatcttggcaacaggtcttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtaagaaaaaagaattggtaaataagactgaagaatatttcaatgccatccgtaccaatattcagcttagcggagcggatattaaggttgtaggcattacctctgttcaatcgaatgaaggtaagagtacaactgcggctagtctcgctcttgcctatgctcgttcaggttataagaccgttttggtggatgcagatatccgaaattcagtcgtgtctggtttcttcaagccaatgacaaagattacaggcttgacggattacctagcagggacaacagacttgtctcagggattatgcgatactgatattccaaacttgaccgccattgagtcaggaaaggtttcacctaaccctactgcccttttacaaagtaagaattttgaaaatttacttgcgactcttcgtcgctattatgattgtgttatcgttgactgtccaccattaggactggtaattgatgcagctatcattgcacagaaatgtgatgcgatggtgctggtagcagaagcaggcaatgttaagcgctcatctttgaaaaaagtaaaagagcagttggatcaaacaggcacaccgttcttaggcgttatcttgaacaaatatgatattgccaccgagaagtatggtgaatacggaaactacggaaattacggcaaaaaagcttaatttctcagataatataagtttgataagtaggtattagtatgattgatattcattcgcatatcatatttggtgtagatgacggccccaaaactattgaagaaagtctgagtttgataggcgaagcttatcgtcaaggtgttcgctatatcgtggcgacatctcatagacgaaaagggatgtttgaaacaccagaaaaagtcatcatggctaactttcttcaacttaaggaagcagtagcagaagtttatcctgaaatacgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgatgctacttgggctaactcccgtacttgctcatatagaacgatatgataccctagcgtttcatgcagagagagtagaagagttaattgacaagggatgctatactcaggtaaatagtaaccatgtgctgaagcccgctttaattggtgatcgagcaaaagaatttaaaaaacgtactcggtactttttagagcagggtttagtacattgtgttgctagtgatatgcataatttatctagtagacctccgtttatgagggaggcttataagttaataacagaggaatttggcaaagataaagcgaaagcgttgctgaaaaagaatcctcttatgctattaaaaaaccaggcgatttaaactggttactctagattgtggagagaaaaatggatttagaaactgttaccgataaacttttagagcgcaacattaaacgattgatactcatgtgcatggatacgtgtcttattatagtttccatgattttgagcaggctgtttttggatgttattattgacattccagatgaacgctttatttttgcagttttatttgttttaatattctacctgattatctcagttagactaaaggttttttcgctaattacgaggtatactggatatcaaagttatgtgaaaataggactgagtttgatatccgcttattcattatttttaatcatttcaatgattctatggcagacctttagttatcgtttcatcttagtatccttatttttgtcgtatgtaatgctcattactccgaggattgtttggaaagtcttacatgagacgagaaaaaatgccattcgaaagaaggataacccactaagaatcttagtagtaggtgctggagatggtgggaatatttttatcaataccgtcgaagatagaaaattgaattttgaaattgtcggtatagttgatcgtgatccaaataaacttggaacatttatccgtaccgctaaagttttaggaaaccgtaatgatattccacgattggtagagaaattagctgttgaccaagtggtgattgccatcccttctttaaatggtaaggagcgagagaagattgttgaaatctgtaacactacaggagtgaccgtcaataatatgccgagcattgaagacattatggcgggtaacatgtctgtcagtgcctttcaggaaattgacgtagcagaccttcttggtcgactagaggttgttttggatcaggatgaattgaatcagtttttcaaagggaaaactatccttgtcacaggagcaggtggctcaatcggttcagagttatgtcgtcaaattgctaagtttacgcctaaatgcttgttgttgcttggtcatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttccattgatggaatataatccacatgaagcagtgaagaataatatttttggaacgaagaatgtggctgaggcggctaaaactgcaaaggttgccaaatttgttatggtttcaacagataaagctgttaatccgccaaatgtcatgggagcgactaaacgtgttgcagaaatgattgtaacaggtttaaacgagccaggtcagactcaatttgcggcagtccgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatctttgtcttggatatgggtgagccagtacaaatcctggaattggcaagaaaagttatcttgttaagcggacatacagaggaagaaatcgggattgtagaatctggaatcagaccaggcgagaaactctacgaggaattgttatcaacagaagaacgtgtcagcgaacagattcatgaaaaaatatttgtgggtcgcgttacaaataagcagtcggacattgtcaattcatttatcaatggattactccaaaaagatagaaatgaattaaaagatatgttgattgaatttgcaaaacaagaataagaaagtaaaaaatatttttactttcctagagtttaaacgatgtttaagttctaggaaggttggaattgctttcgtggaggtgatagatagaaacctatatatttgtagaagaaaggatattaaactaaaggtgaatcggaacataaagtttagatagagttggtatttaatgccaaacaggtgaatgcaacctctcgctcgttactaagcaggagatagtaaagttgcttgaaagagagtttgttaatcagtataagtaggctaaagtgagaatatatatctattattatcggtaatgatactattattgagaattattgtagtggggataaaaataatttttggtgattttatcgtccgacttaaaggtgggttaaaaaagtacttatattcttttagaattgatgaaaaatatgggggaatataatatttataggagatacgatgactagagtagagttgattactagagaattttttaagaagaatgaagcaaccagtaaatattttcagaagatagaatcaagaagaggtgaattatttattaaattctttatggataagttacttgcgcttatcctattattgctattatccccagtaatcattatattagctatttggataaaattagatagtaaggggccaattttttatcgccaagaacgtgttacgagatatggtcgaatttttagaatatttaagtttagaacaatgatttctgatgcggataaagtcggaagtcttgtcacagtcggtcaagataatcgtattacgaaagtcggtcacattatcagaaaatatcggctggacgaagtgccccaactttttaatgttttaatgggggatatgagctttgtaggtgtaagaccagaagtacaaaaatatgtaaatcagtatactgatgaaatgtttgcgacgttacttttacctgcaggaattacttcaccagcgagtattgcatataaggatgaagatattgttttagaagaatattgttttcaaggctatagtcctgatgaagcatatgttcaaaaagtattaccagaaaaaatgaagtacaatttggaatatatcagaaactttggaattatttctgattttaaagtaatgattgatacagtaattaaagtaataaaataggagattaaaatgacaaaaagacaaaatattccattttcaccaccagatattacccaagctgaaattgatgaagttattgacacactaaaatctggttggattacaacaggaccaaagacaaaagagctagaacgtcggctatcagtatttacaggaaccaataaaactgtgtgtttaaattctgctactgcaggattggaactagtcttacgaattcttggtgttggacccggagatgaagttattgttcctgctatgacctatactgcctcatgtagtgtcattactcatgtaggagcaactcctgtgatggttgatattcaaaaaaacagctttgagatggaatatgatgctttggaaaaagcgattactccgaaaacaaaagttatcattcctgttgatctagctggtattccttgtgattatgataagatttataccatcgtagaaaacaaacgctctttgtatgttgcttctgataataaatggcagaaacttttcgggcgagttattatcctatctgatagtgcacactcactaggtgctagttataaggggaaaccagcgggttccctagcagattttacctcattttctttccatgcagttaagaattttacaactgctgaaggaggtagtgtgacatggagatcacatcctgatttggatgacgaagagatgtataaagagtttcagatttactctcttcatggtcagacaaaggatgcattagctaagacacaattagggtcatgggaatatgacattgttattcctggttacaagtgtaatatgacagatattatggctggtatcggtttggtacagctggaacgttacccatccctgctgaatcgtcgtaaagaaattgttgaaaaatacaatttaggttttgaaggaactcaaattaaaccattggtgcatcagtctggagctaaacaatcatccatgcacttgtatatcacacatctggaaggctttactttggaacaacgaaatgaagtgattcaaaaaatggctgaagcagggattgcttgcaatgttcactacaaaccattgcctcttctcacagcctataagaatcttggttttgatatgaaagattatccgaatgcctaccagtattttgaaaatgaggttacacttcctcttcataccaacttgagtgatgaagaggtggagtatgtaatttctaaaattaaagaaataacggagagtttccatgagtagtgaattatatggcataagtgttttaatgtcggtatataaaaatgaaaatcctgtttttttggcagaggcaatcgaaagtattatacatcaaactcgtaaaccagatgaaattgtcattattgaagatggccctctaacagttgagctcaacgaaattttagaaaaacttcaaaatgagtacaaaaatttaatttttacttataaaataaaaaacaatattggattaggattggctctgaaatttggtgtagaaaaatgtaggtatccattaattgcacgtatggatacagatgacatagcttgtaagaatcgattagagttacaagaagaggcctttttaaaagatgacaaattagatattattggtggacatatttctgaatttgtaaatgactataataatcctgtatcaatacgatatgttccgttacaacatgatgaaatagtaaattttcaaaaaagacgaagtgcattcaatcatatgacagttatgtttaagaaaacagctgtattgaaagcaggtaattacgaacatggtttgtatatggaagacgatttattatggaacaatatgttgtcaattgattcgaaggcacagaatttagactgtgttctgtgctatgttcgagttggtaatggaatgtatgaaaggcgtggagggcttaactacttcaatcactacaaagctgcaagaaaaacaatgttgaatcgaagtcagatttctaaatttgattattattatagtttagtaattcagtttttagtggcacttgtaccaacggcagttagaaaatttatttttaggaaattattaagagggtagataaagttgtttgttgcatacttaaatatacttaattaattgagggagataaagttagaaagaaattggcaatccaatgcaaaaaaaacaggctataatgtttctagtacataataatataaaatatttcgaaaaattattaatattacttgatagtgatttttttgatatttttattcatgtggataaatcagctaatttatctgaatttcatcagattattaaaaagttgactaaatcacgagttttcttcgtttcagatagaattgatattagatggggtgatttttctattgtagaggctgaattgttattattaaaattagcacaaagtaacggtccatattcttattatcatttgctttctggagctgacttcattataaagaaacccagacagatttttgaattctttgcaaatagtgaaaatgttgaatatattaatttttttgatgtgccgattgagaaagaagagttttatcaaagacgctataaatttcgatataagagaaagtatcctaaaaaaaaatcagtatggaataaggcaatatatcaaatttatttaaaatattgtcagtatattcaaaaagggcaacagagaaaaaaaatgggaataaatttttatgttgggtcgcaatggtttagtattacagataattgtgttagttatattttatctcaaattagtttgataagggagctatttgttgaaactttggtaccggatgaaagctttattcaaactttaatttgtatgaatgaggaactccgtagtaatattgtttctgatccaataaactattcctcgattaaacgtgatattcaatttatagatggaaaacctaaagtttggactattgctgactatgaggaattaatgttttcgacttcattttttgctagaaaatttgaccaacctatatctgataaaataattgaaacattaataaaagaattacaagaggagtaataaaatggagataaaactagctaatttagaggatattgatgagattgtaaaatttcataaagagcaattttctgattattatttaactcaacttgggtcttctatactgagtcgttattatactttttttattacatcatcagtaaataattgttttgttgtacttgaaaaggataaaattattgctttggcgttgtttgtcaatgactttgagtttcatatatcgaaattttatgcaaataacaaagtatttctagcaacgagtatcattaaagcacttcttggaatgaatagaattgtctggaaagggacagctgaaagagtaatgaacttatttagaacatcggaaaaagcttttgatttacctaaactaactttactttccttagcggtatctaattgttacagaggaaatggaattggaaaaaagttaattaattttgctgaagaattttatatagataaaggaattgaaagttattatttaagtgttttaagtagtaactatgatgcaataagattttatgaaaaaaatggttttaataaaatgaatagtgatagtagactatattatatggagaaagtcttattatgatacctagaattcaatttagatatttgagggaaatttttatagctattggattttcaagtaatttactaggctatttgttaggtaatttttcattttcaaaaataattatgttaatagttattgtttttttgttaaaattatctattaataatggtttcaagattttatttaacactaaaatagtgttgcctattatatttttattgtttatatttattgtttcctttctaaaatatgactatctgtatacccaaacttattttgtttattttcttctatattcgatattttctattctctcatttcaagagaaaatacatttttctaaagtattagaatatttatctattattctgtttttatctataccattagctattaggccacaagattatgatattggctatcttttggggttatcatataattttttgactggttatttgacagcgatttatttactttttttcaataaagagaaaaaaagcatatttgttattttaatttgtgtcataaatttatttatttattcatatttttatgcattcttaggaaatagaggtgcaattttattaattgtaatttatttattcttaaaatggtatcttacattaaataaatctatcataggtagagttgttcaatttttttctgcgattatttctatttttataattcaaaactggattcaattattgatttggttaaataactttttacagtcattaggtttaaatatctatgcaatcgaaaaaacaataaatttgttaattagtaatcaaaatattgatagtggtagaaattttttggtaaataaattatttacacttgttgattttgacgatttgttttttgggaaaggaattggctttatagaaactacattggggatttattcgcacaatttgtttgttcagagtttatttgaagggggaatttacttctctatattcctcctatatgttctgttcaaattatttagcatttttgctaaggagaaaacatggtttgccaactttgtattgcttgccactgtttctgttatgggacaattaatgttatcaaatgtttattggttaaatcctattttttggtttttattttatttagtattctttactagagaatacttggaaggagataaagtttgttgaattataatatttcagtagtaattccgacaattggcagaactaatttattagagagagccataaaatctgtgttaaaacaaacggttgaagtagttgaaattattgtagttgttgatggaaaaagtgaggaagtaaatttactttgtcgacggcttgaaaacaaaaagataaaagtacttcagttaggttcctcgcatgggggaagttatgcaagaaattacggaatcgatcaagctaaagggaaatgggttgccttacttgatgatgatgatgagtggtttgataataaattggagaagcaaattcaacttattcactcttataataatagtgttgacatgattttctctcaattggttacttataataaaaatggaaagaaacaaatattacctagaagaaaatggaaaaagcattataggattgatgagtatttatttacaccattttttggtaaatacgcaggatatattcaaacttctagtatattggcaaaaaaggagttatttgtggactttccattcacaaatggcttgccaaaacatcaggattgggactggttactaaagatacaaagcaaagatgatttaatagtagattgtgttgaacaaccattattatattaccatcaagatatatcagctagtgtagggaaagtgaataagtggagagagtcaaaaaaatggatagattctattttcccgcaaattagttggaaaagttacggtttttttaatatactaattgtaattccggatatgcttaacgatgcatcaataacaaagtatgagaaaatcacttattttaaggagatgaggcaaaatttaaaaattaagcatattttttctttgagatatattgctcttttgttaaaattttttagattgttaatatcatgaacaaagtaataaaaaatgttgtgtaccaattagtttatcaaatttctcgtattataatccctattattacaattcctattgtttctagagtattgggagctgtaaatttggggatttataattattattattccatagttagttattttatattatttgcaggtctggggataacattatatggtagtagggaaattgcaatagtgaagtctgataacgaaaagctttcgcaagtgtttatagagctatttattatgaaaggtttggtgacatcaattgtacttttcatatttatagggtcagtataccattttaacactccgaaatatttactgcttttctcaattgctatactatccgtattgtttgatgtttcttggtattttatgggtgtcgaagattttcaaaaatttagtttgattaatataactagtcaggttctagtatttatattgattattttttttattcgggataaaaatgatttgacattatacattatttttcaatccataggtttacttcttccaaatttgatatccatattgttattaccaaaagaattatttactttctctgtcaaaattagaaatatttttaaacattttattagttcgcttggctattttttcccgcagatagcgattacattatatactactttaaacaagacaataattggattattcttggatacaacatctgttgcttattattctaatgctataatagttaatagtgttataataacagtaataactacagttgatactgtacttctacctaggatgagttcactattttctcagaatagaaaagatgatatgtttaaatggttaaagaattccttaaatattcagttgtttttttctataggggcaatgtttggagttttgagtatttacaataggttcgtaccattcttttttggagaagagtttatattcattattaaacttattccattattatctaccctaatagttattgttccagttggaatgtcaatttctagacaatttttattaccacaaggtaatacaaaagattattttgtgtcgatagttagtggtgctattataaatattggactaaatatctttttactacctcaacttggagttgtcggagtagtgctttcgaacatatttgctgaattatttgtaacaattgttcgtctcaaaccgttaataaatgagtatggattgccatttaattttagggatgttgttgtatatatactctgtggtattagcattcttggaactggttttattaataattttattatccattcaaatttcttattcatcatatttcaaacttttgtaggagcttctatatattttctcttgacgtatatagtaggagttaatcctgtcaagaaaattctaaatagaaagtacggatgataatcaaatctagttatttattttgtatacatatttttatagattttataagtttatagctatgacttaagctatttgaagtaaatagaatagtggttaatattataaagtgttgcaattttctataacaaatgctatactttgtacatcatttgttatagaggtgttacaatgagcaacaaatttttttcatatgaaaagttgaaaagcgtcattgctattaaaagaaaacaattaggtaattctcaacaagaacttgcagataagtcaggtattaatcgtgctatgattagccgaattgaacaaggaaattatattccatctattccacaactggaaagtttagcgcaagttttggaatttgatgtagaatcgctatttatatctaatagtgaagataataatgaaaattcctcagtagccaaggtcgcaaagattaatatcgccgtcgcaggaactggctatgtcggcctatccatcgcggtcttattagcacagcaccatcaagttactgctgctgatgttgtgaaagaaaaggtagatttgattaatgctaggaagtctcctatacaggatgattacattgaaaaatatctagctgaaagagacttaaatctagttgcaacgttggatgcagaaaaagcctacaaagatgcagaaattgttgtaatcgctgctccaactaactatgatagtgctaagaactactttgatactagtcatgtcgaagcagttatacaaacggtattatcggtcaaccctcaagctttgatggttatcaaatcaacgatacctgttggttttacccaatctatgcgtgaaaaatttggtacggaaaatattatttttagcccagaatttttacgggaatccaaagcactttatgacaatctttatccctcgcgtatcattgtatcttatgagagtaattcaccacaaacagttattgagggggcgaagctttttgcaaaacttttacaacaaggtgctctaaaagaaaatgtcgaagtattacacatgggtgctacagaagcagaagcagtcaaactgtttgctaatacttatttagctttgcgtgtttcttacttcaatgaattggatacttatgcggagctaaaaggattagatacagaatcgattattcgaggagttggtttggatcctcgtatcggtgatcattataataatccctctttcggatatgggggttattgcttgccaaaagatacaaagcagttattggctaattacaatgatattccgcagaacatgatgacagccattgtagagtcaaataggactcgtaaggattttattgctgatcaaattttgaagatagctggttattatgattattcgtcacatgatcaatattctcaatcgggagaaaaagaagtgatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacacctagagaggacgaaattcgttctctcatttttgatgtttaaagcaatatatatcttggttttaaagttcctaaagccgaacgcttgcctcttgatgtctttgatgagtttattggtcgcttccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgccagtgatttttcctggatcgataaggtagggaacgcgtatcgaaagtcttcataatatcaattctagtcgtcatcatagcacggctcaggtattggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtggtttggcggttgttgtcaagaatggtcacaatcgatctcgtctcaaaattctgagcaataaaggcgagttttcccttgttccgactaaattcatcccagctcaagacttttggtaatttcgtaaaatcatgctccaattgaaactgagccagtttcctctggacgaccgatacggagatatgtaatctcctagcgatggctatattggtcatgttttctgtatggagttgagagactttctcccaaataggtagggaaatctgacagtttttcttgactagagctgtctcagctacagtcactttttggcaagatttgcattgaaaccgccgtttcttaagcaagaggagggtcggaaagccctgacaatccaaaatcggaatctttgacgacttttgaaagtcgtacttgatacactttccttggcaatgaggacaaccagggctgtcgtaatctagctttgccctgatttctagatgggtctgatgtttcaaaatgaagagaattttgatgtttttgtctttgattccaattagttctgtggtatgataaagttgttccatatgagtctttctaatgtgagtgtggttgcttttcattataggtcatatgggactttttgtatatactcaaaaaggctccataatctctacagtggatttacccactacagaaattatagagccgaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaacaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcttcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacacttggttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagaaatcagtgtataaaattaataaatttgaaggtgaaatctatcagaagttaaataaaattcttgattcatataaccaagaacagaatagcctgataaaccttgctgcatgtattagctatccattcaccgaagtattaaagattcaaagtttccctctcgctactctgccaacagagggagctgttgaaaaacgcttttttcctcattgtacttcattggataatattgaagtatattcagaagaattgtgtcttcaactttttgatttaaatcctggtgattatagagttaatgtgcaaccacattcaggaactcaagctaaccaaatagtctacaattgtgttttagaaagagacgattatattttatcgttatctccaaaagacggaggacatatttcgcatatttatacaggtaaaggtactgtaaaatattatcacttagaccataacttaaatattgattatatcgaattaaaggaattattagataaatataaacctaaattgattattattggtgcttcgtcgtatggaaatgaatttaattatcaacaaatttatgaaattataaaagaggttagcccaaataccctcatcttagcggatatttgccacagtgttttatatattatggcaaagctacataagtcgatttttccatatgtggatttcgctacttttacaatggataaatgtttacgtgggcctcaaggaggagtactactgtatcgttctatatttgaagaaaaaataactaattcaatttttcctagaacacagggtgggcctacacaaactgcattatttgcgaaatgtatctgtttaatcaaattattatcaatagatattcaagattatgctaaacagattataaaaaatactttattgtttataaaacaattaagtaaagagggggttgatgttgtttataaaaaaccaaagactcatataattttagttaatctattgaatctaaacttgagtggtaaggaggcagagaatctactttttcagcataaaatattagttaaccgaaatcaaattccaaatgatacacacggaccaatgacgacttcaggaatgagattaggaacagttggaattacaaatttatcctatactgatgaagatataaaaaaaattagctaaactagtagctaatttattaaaatataaacaatatgattattccatatatttagatctcattcacaagtaccatgaacaaattaatatctccaattaggagaaagacctatacagaaattatattttttgtatggaatcaacagatagtatttggtgagcccgtcttgataatcatcaatataagttttttcataaacaaaaggaatatcttcaaattgttgtaaattgtatactatttgaaatttataccaaggatcgtctatgagtggaatttctgcctcaaagctctttagtgaattttgaaattctgtaaaagagattttttcagaaatcaactcaataattaatttgtttaacttgagcatcctaatatctaaggtcaaagctttaggacattcttgaagtgatttatttataaattccagagattgttgataatttttattcatcagaaaaataattgatttattacaatatggttcaaaaatttcatttgaatcatatttttttagtattttttcggccttatttatattctctaaagctatatcatattgcccatcccatatattaacaacacctagattattatatactgttgcaacaggtatttgatattcattacgttgaaaatagtccaatgctaattcgagatttttggtagcttctttggttgggaaataatgagcagaatttcgtaaaataatataatagaagtcgtctttttctacagaattcatggtctcattaaggagtttaattgcatcttgatctttacctaaatgaccataagcatttaacttgtagagtaatgttccagagctattttctaacttttccagtgattttagtgcctcctcaaattcatatttttgaatttgaaatctaggatagtatagttgtaaatcttttgaataattatcttgttgaaggctatttaaaatagctaagcctccattgaaatcagaaatccactggtacgagttcaatatataatgtaagtatttttatggtaataattctattaaatgatgtatcttcttgctcaaagatgcaatgtaaaaatatgaatttttcctgtattctatttcaagtaactgtttgatatattctacattttgtcgtaactctttaatattacatatatttattaagcagtgaattaaataagctaactcgccaccaactcctatagataagatagtttgctctaaatatatttttagattgttggttactaattgaagatcagaagtatttgtgtgatttaaaatactatttacaattgattcgtgtgaaattttgattttatcatttgtatctccattaatatatacgaaacctgcatcaataagggattttagagaatcagctacttcaatattttcatctactatagatttaatgtaattaaaaactatatcttttctcataccagcaggaaaaattgatgatatgagaagtatatttttttgaatatctggaagtttgtcatatatatcagaaatattaaataattctgaatttggattatcaataagtctgttaataatcaattcaatctctttatagttaccttgtgttatctgccagatttgattcaatttgatattatcaagtaaagcaattttatttcttattagtaatttacactcatcctcagtaagatacgataaatttaatacagtaggagtataattgtccaatgtatctagtttatcaattgattttaacttatcagttgttcggtttataatagttaaggagactccgctttgaagtgtattaaagtcatcttcaaattttatttttatatcttcagataaaaattgataattatcaataataatattcagacggattttttttgaaacatgactgaaatatcttaaatataaatcactttcaaatattccctcctttatttcagtaacaacttcttcccaaggataatcaattacttttttataggttgtatcgaatgaaatcaaagatctgattaacctaaaactatgtttcagagttagatttgttagtttttgttttcttaaataatttgaaaatgaatatttttgaggtattgataagcatagatttcttctgaattgagttgggacatacgctccttttagtagattttcaaaaaatttattactttcaaacccgtcatttgtaacatcaatgtagagaataaacgcttctttatcatgactgtaaacttgttgacaaacctctttgattaactcggttttaccactaccacttaagccattaataatatataaactatttttatcattactggaaaatttaaaatgctgttttaattcttctatttcagtatcgcgaccgtaatacataaaacatctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaac

SEQ ID NO: 38 - DNA, 29176 bp, Streptococcus suis
attacaggtgggttatcgggtagttttaatgcggcacgagtagctagggatatgtatatcgaagagcatccgaatgtcaatatccatttgatagatagtttgtcagccagtggggaaatggatttacttgttgacgaaatcaatcgcttaattggtgcaggactagatttttcacaagtagtagaagcaataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagtgagagagctttttgcatgataagattggtatcgtagtcgattagactcttatgtttgatgaaggtatcacgtagctggttaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagatagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagccggtgctggatgccataagtcaatttgatgtaaaaaagatggctgctttttataaattgaatgaagaaaaggctgagttagaagctgaccgttggtatcgaatcaggacaggtcaagcaaaaacttatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgcttagattttcaagggagcttaaagatagacaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagttatgaacaagattgaacaagataacgtttttcatcactaaatatggctatgtggctagtaaaatattgttttttgtgatacaatagatgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcacttgtcatcacttctgtcggaatctatggaatgcaagaagttgtaaaattttcaacacgactaaattcaaattcggcattttcagaatatgaaatgagcatcctcgtcccagtaaatagtgagattacagatgttcgacaggtcactaatgtacttgctccggctgaatacgatcaagacaacatcactgctttattaaatgatatttccaaaatggagtctactcaattaactacaagtccgacgacctcttatctaacagcctaccaagctatgctaaatggcgagagtcaagcgatggtcttcaacggagtttttaccaatattttagaaaatgaagattcagacttttctccaaaagtgaaaaaaatatatagtttcaaagtgactcagactgttgaaacagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacattgctattgcagatggtgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgaggtcaccagataatctagcgaattatcaagctattctaactggtttggaaggatctatccaaacagatttgagcttagaaacgattatgggcttggtaaatacccaattagaatcaggaacacaatttacagtagagtcacaagcagtgacaggaacaggacgctcagatttatcttcttatgcgatacctggttcacaactttatatgatggaaattaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaaatcttcattctagtaactgcggtattaggagcagggctggcatttgtttatagcagttttttggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggcgcaaaagattgttgaggtcactaaggtaagcgatgtgacaacacttgaagaagcagtcccagcggaggaaccaaccactccaaatacaaaacgaaatatcatacttggcttattagctggtggtatcttggcaacaggtcttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtaagaaaaaagaattggtaaataagactgaagaatatttcaatgccatccgtaccaatattcagcttagcggagcggatattaaggttgtaggcattacctctgttcaatcgaatgaaggtaagagtacaactgcggctagtctcgctcttgcctatgctcgttcaggttataagaccgttttggtggatgcagatatccgaaattcagtcgtgtctggtttcttcaagccaatgacaaagattacaggcttgacggattacctagcagggacaacagacttgtctcagggattatgcgatactgatattccaaacttgaccgccattgagtcaggaaaggtttcacctaaccctactgcccttttacaaagtaagaattttgaaaatttacttgcgactcttcgtcgctattatgattgtgttatcgttgactgtccaccattaggactggtaattgatgcagctatcattgcacagaaatgtgatgcaatggtgctggtagcagaagcaggcaatgttaagcgctcatctttgaaaaaagtaaaagaacaattggaacaaacaggaacgccgttcttgggagttatattgaacaagtatgatgtggtcactgaaaaatatggtgaatatggaaattacggaaaaaaagcctaatttctcagataacataagtttgataagtaggtattagtatgattgatattcattctcatatcatatttggtgtggatgacggtcccaaaactattgaagagagcctgagtttgataggcgaagcttatcgtcaaggtgttcgctatatcgtggcgacatctcatagacgaaaagggatgtttgaaacaccagaaaaagttatcatgactaactttcttcaacttaaaaaagcagtagcagaagtttatcctgaaatacgattgtgctatggtgctgaattgtattatagtaaagatatcttaagcaaacttgaaagaaagaaagtacccacacttaatggctcgcgctatattctcttggagttcagtatgaatactccctggaaagagattcaagaagcagtgaccgaagtgacgctacttgggctaactcccgtacttgcccatatagaacgatatgatgccctagcgtttcatacggagagagtagaagagttaattgacaagggatgctatactcaggtaaatagtaaccatgtgctgaagcccgctttaattggcgatcgagcaaaagaatttaaaaaacgtactcggtattttttagagcaggatttagtacattgtgttgctagtgatatgcataatttatctagtagacctccgtttatgagggaggcttataagttgctaacagaggaatttggcaaagataaagcgaaagcgttgctgaaaaagaatcctcttatgctattaaaaaaccaggcgatttaaactggttactctagattgtggagagaaaaatggatttagaaactgttaccgataaactgttagaacgcaacagtaaacgattgatactcatgtgcatggatacgtgttttcttatagtttccatgattttgagcaggctgtttttggatgttattattgacataccagatgaacgcttcattcttgcagttttattcgtatcaattttatatttgattctatcgtttagattaaaagtcttttcattaattacgcgttacacagggtatcagagttatgtaaaaataggacttagtttaatatctgcgcattcattgtttttaattatctcaatggtgttgtggcaggcttttagttatcgtttcatcctggtgtccttatttttgtcatttgtaatgctcattaccccaaggattgtttggaaagttttacatgagacgagaaaaaatgctatccgtaagaaggatagcccactaagaatcttagtagtaggtgctggagatggtggtaatatttttatcaatactgtcaaagatcgaaaattgaattttgaaattgtcggtatcgttgatcgtgatccaaataaacttggaacatttatacgtaccgctaaagttttaggaaaccgtaatgatattccacgattggtagaggaattagctgttgaccaagtgacgattgccatcccttctttaaatggtaaggaacgagagaagattgttgaaatctgtaacactacaggagtgactgtcaataatatgccgagcattgaagacattatggcggggaacatgtctgtcagtgcctttcaggaaattgacgtagcagaccttcttggtcgaccagaggttgttttggatcaggatgaattgaatcagtttttcaaagggaaaacaatccttgtcacaggagcaggtggctctatcggttcagagttatgtcgtcaaattgctaagtttacgcctaaacgcttgttgttgcttggtcatggagaaaattcaatctatctcattcatcgagagttactggaaaagtaccaagataagattgagttggtccctctcattgcagatattcaagatagagaattgatttttagcataatggctgaatatcaacccgatgttgtttatcatgctgcagcacataagcatgttcctttgatggaatataatccacatgaagcagtgaagaataatatttttggaacgaagaatgtggctgaggcggctaaaactgcaaaggttgccaaatttgttatggtttcaacagataaagctgttaatccgccaaatgttatgggagcgactaaacgtgttgcagaaatgattgtaacaggtttaaacgagccaggtcagactcaatttgcagcagtccgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatttttgtcttggatatgggcgagccagtacaaatcctggaattggcaagaaaggttatcttgttaagtggacatacagaggaagaaatcgggattgtagaatctggaatcagaccaggcgagaaactctacgaggaattgttatcaacagaagaacgtgtcagcgaacagattcatgaaaaaatatttgtggggcgcgttacaaataagcagtcggacattgtcaattcatttatcaatggattactccaaaaagatagaaatgaattaaaagatatcttgattgaatttgcaaaacaagaataagaaagtaaaaaaatatttttactttcctagagtttaaacgatgtttaagttctaggaaggttggaattgctttcgtggaggtgatagatgatcacctgtatattcgaggaagaaaggatgttaaactaaaggtgaatcggaacataaagtttagatagagttggcatttaatgccaaacaggtgaatgtagcctctccctcgttactaagcaagagatagtaaagttgcttgaaagagagtttgtcaatcagtataagtaggctaaagtgagaatatatatctattattatcggtaatgatactataattaataattattgtagtggggataaaaataatttttggtgattttatcactcggctaaaggtaggttaaaaagtacttatattctttagaattgatgaaaaatatggggaatataatatttataggagatacgatgactagagtagagttgattactagagaattttttaagaagaatgaagcaaccagtaaatattttcagaagatagagtcaagaaaaggtgaattatttattaaattctttatggataagtttcttgcgtttatcctattattgctattatccccagtaatcgttatattagctgtttggataaaattagatagtaaggggccaattttttatcgccaagaacgtgttacaagatatggtcgaatttttagaatatttaagtttagaacgatgatttctgatgcggataaagtcggaagtcttgtcacagtcggtcaagataatcgtattacgaaagtcggtcacattatcagaaaatatcggctggacgaagtgccccaactctttaatgttttaatgggagatatgagctttgtaggtgtaagaccagaagtacaaaaatatgtaaatcagtatactgatgaaatgtttgcgacgttacttttacctgcaggaattacttcaccagcgagtattgcatataaggatgaagatattgttttagaagaatattgttctcaaggctatagtcctgatgaagcatatgttcaaaaagtattaccagaaaaaatgaagtacaatttggaatatatcagaaactttggaattatttctgattttaaagtaatgattgatacagtaattaaagtaataaaataggagattaaaatgacaaaaagacaaaatattccattttcaccaccagatattacccaagctgaaattgatgaagttattgacacactaaaatctggttggattacaacaggaccaaagacaaaagagctagaacgtcggctatcagtatttacaggaaccaataaaactgtgtgtttaaattctgctactgcaggattggaactagtcttacgaattcttggtgttggacccggagatgaagttattgttcctgctatgacctatactgcctcatgtagtgtcattactcatgtaggagcaactcctgtgatggttgatattcaaaaaaacagctttgagatggaatatgatgctttggaaaaagcgattactccgaaaacaaaagttatcattcctgttgatctagctggtattccttgtgattatgataagatttataccatcgtagaaaacaaacgctctttgtatgttgcttctgataataaatggcagaaacttttcgggcgagttattatcctatctgatagtgcacactcactaggtgctagttataaggggaaaccagcgggttccctagcagattttacctcattttctttccatgcagttaagaattttacaactgctgaaggaggtagtgtgacatggagatcacatcctgatttggatgatgaagagatgtataaagagtttcagatttactctcttcatggtcagacaaaggatgcactagctaagacacagttaggttcttgggaatatgatattgttattcctggttacaagtgtaatatgacagatattatggccggtattggtttggtacaattggaacgttatccttctctgttaaaacgtcgtagagaaattattgaaaaatataatgcaggttttgagggaactttgattaagccattggtacacctgacggaagataaacaatcgtctatgcacttgtatatcacgcatctacaaggctatactttagaacaacgaaatgaagtcattcaaaaaatggctgaagcaggtattgcgtgcaatgttcactacaaaccattacctcttctcacagcctataaaaatcttggctttgatatgaaagattttccgaatgcctatcagtattttgaaaatgaaattacactaccgcttcatactaatctgagtgatgaagatgtggagtatgtgatagagacgattaaacacattgtttatgtaaataaataggggagttctcgtgaaatatagtgttttaatgactgtgtataaaaatgataatgctgattatttttatattgcattgaatagcatggttcaacaaacaataaaacctgatgaaatcgttattgtaaaggacggtccgattcctaatttgttagaacaggttatcgttaatgtacaaaacagttgtgatatttactttaatgaaattcaattaccaaataatgttgggcttggagaggcattaaatgcaggtctaaaagaatgtcggaatgaccttattgcaaggatggatgcggatgattattctcttcctcaaagatgtgagttacaacttatggaatttgaaaaagataatactctagatattatcggttcgtcggttgaggagtttatttctgaattgaataatatagtaggatgtaggatagtaccaactactcatgatgaaatctataagtttgctaaaaaaagagacccgtttaatcatccgacagtgatgtatcgtaaatcgtttttaaataaaatcggtggctattcagactatcgtaaaaatcaggataccgatctctggattagaatgctggaatcaggtgcaaaaactaagaaccttgatgaaattgtattcaaattcagatttgaacaaaatacttttgaaaaacgaaaaaactggtttaacactaagacgcttattcacattcgatacaatgcttggaaacgaggatttaatagtttgggcgattttttagaaataacagctgcccaaattgctgtctacatcttgcctcaaagtttccaacgatttttatataaatattttttgagaggatagagaatgataggtagagctgtggttaagattgaatcaatcatacattatctttttaatttttcgttgtattttccaaagagagtgaaaatatacggtaaacctagggttttatttggagaaaaaattgaattttctgagaatgtaaggattaatgacaaggtttttttacatgctgtaaatggaattgctattggaaaaaattcaacattatcttatggggcaactttaattacagagtcctatgatgttacaaatagagaaaaatatatgaaacggctacataaaggtgctagaattgaaataggggataatgtttggattggtgcaaatgtcataattctaccaggagtgaatattgctgacggtgtaatcgtaggcgcggggtcagttgtcacaaaatgtttgactaaaaaaaattccctatatgcaggaaatcctgctaaatttatcaaggagtaccaagaatgaaattgttacatgtgacagctacccatttaaaacctactggaggtatacctgttgttttaagtgagttggtttctcatcagaatgcattaacaggatttgaagcacgagttttgtctataaaatcaccagtgaaagatatcaattctgcatactttgactttttaggtgatagattatttgaagattatataaagttttatttaccggatgtagttatttttcatagtttctatttttgggaatacataaagttgtacaaaattttaaagaaaagtaatatttcgtattttattcaacctcatggatcgtttatgattgagtcaatgaaaaaatctagaataaagaaaactgttgcaagagctttattttttgataaatttgtaagaaactctgaggggataatttatttaaatcaatctgaaaaaataaactctctatacaaaagcgaaacaaatctgattattccaaatggcattgcagttgaagcttcaatgagagagtatgattataaatacaagagtagctctagtgttgagttttattatttaggtagatttgatataaatcataaagggctggacatattaattgattctttagagatgttggataatatgtgtgagggtaggacgattactttttctttctatggcatcggaaatcatagtcaagttgagtatattgaaaataggatttgccagttaaggaatataaatgtatgtaataaagggccgctaattggaaaagagaaggctgaacatttgcgcggaaagattatggtcttgacttcacgctatgagggatttccaatgactgtcttagaagctctttcttatggtaatccatgtattgtcacaaaagaaacaaatgtacttgatgaagttgttctgaataatttaggatgggcttgtactttagatgcacaatcaattgcttctgctatgcttaaagcttatgatgactatctgactagccaggaagagtattttgcaaattgtgtccattatgttactactgaatattcttggggaaggattgctcatatttcatttgaggaattgaagaaatttgaacggggatagaatgaaaaaaataatgatattagggtatttaacacaatccaaaacaggcaataaaagttttggaggagcggagaggaatatggtcatgttagctaattctttagctgagcgaggttatgatatttgtctgtgctctgttgaaggaagtcacttaccctatcaattaaatagtgatgttgaattgctgactagtgaagtaagttataaaaataagttaaaaacgcacggtgatatatttttcaatactataaaaagtatccggaatgtacaacctgatctaattatttctttttggcctcatccgactttttatgcactactatttacaaaaataaaaagaataaaaatgatttattctgagaggaatgatcctagcagagagtatgcaggtcttgccaagctcttccatacagttatatcttatttttgtaacggatatgtttttcaaaatcaaggtgctcaaagttattttccccagaaatcaataaaaaacagcacagtaatacataatccactatcatttacaaagaaggatgtcccaaatggaacgcgtgttgtaagaaattttaagaggattatttcggtaggaagattaacagaacaaaaaaatcacagcatgttgattggagcgttttcaaaatataatgagacgcaccctgattctatcttagaaatattcggggaaggtgcgctatatcaagatttaaagaaacagattaagatgttgaatatggaaaataatattatcctaagaggaacaacttctcaaattttagaagagattgccagttcggatatgtttgttcttacttcaaaatatgaaggaatgccgaatgtattgatggaggcgttggcattaggggttccagtagtatcaacagatttttctccgggaacagtgagagaattaattactcatggcgtaaatggcttaatctgtgatatcaccgagtctgatttgatagacaaaatgacaatgtatgatgatgagtccttagtagggcaggtttctaggaactctatcaagatatttgaaacacacaatatagaggagataacagatcaatgggaaaggttcttgatagaaacgatgagctgacaatcagttgccatcttgcagcgttgtttacggtgggagcattctttatagaattgttttttaatggtaagtatcttgtctgtacccccgttctttttttaggttatttattttattataatccgaagtttaaagggcagatttccaaaaatttatcaatttttttgatatggttaatatttatttttttacaaattctaatcttaggaatgattcggacaggcaatgaagattttttttccttttattataatttagtattgtttgcaaatctcaccatgattttctttattactgggctcacgagacttgtgaattatcttttaaagtatcttgatttagttgttcaatacggagttttactctgtacaccagttatcttttttaaagaaattgatattatcgaatatcgatggagagattttttaaatgccaattctggctatagactgggagtttcaagtaatataaaccccaacagtattgcatggctctatggtttttttgcgatgttgaccctatattttctgttaaaatcgaaaaaaataaggtatgtcttcttattcgcagtagaactagtttgtatattatttacaggttctaaaacaggagtgttgactgcgtttatccccttaatatttgctttctttaggagtttacgaaaggcaaaaatttctaatgtaattgttattctattggtgggtattattttttggtatgaagttcaaaataatcccgtattatatacgttgattggtaatcgattaaatagttttttagggttatttggaataggaacagtaccagttgatgctggctcgactttgaagagaattcatatgatagaatttgccgaaaatatgatatgggaaaaaccaatattgggctgggggattggggcatttgctcagatatctggttttggagtttattctcataataattttatagagagcctagtatcaggagggattatatttagcactgcatattattctatatacgtattgttgtttttgcagttattttcattatccaaatgtgaggaaaaggaagttgcaattcttttgatagtatcaaatcttttaattgatttttcaacagttacgttttatggtcagctattatcttattttaaaataatcatcattgcaatgctgttgttttatattcagtatattaaagaaagagtagaaaaatgagatttttaaatctttttgaaaaattgataaagagattttcatcccaatcaatatatcaagattatctaagaaaacaaggaatcgtgattggaaacaactgtgaaatatataagagtgcttcatttggaagtgaaccttatttggtgactattggtgacaatgttagaatttctgcggatgtaaaaattactacacatgatggcggagtttgggtcgctcgttatttagtgggaaatcaggaaattgacctgtttgatagagttaaaattggttctaatgttcatatcggcgtcaatgctatcatactgccaggagtaaccataggaaataattgtattattgcggctggggcggttgttacgcactcggttccgtctaatgaaatttggggaggggtgccagctagatttattagtacaatggatgattatattttaaagcatagaggagaatttgaaatgactaagacgatgtcccccaatgaaaaaatgaagtttctattgaagaagtatccagaggtaatgaatgactaataataagcaactttctttgaatattttaatttcaattttaaaccaattggtcattatcgtttgtggttttattttacctagggtacttttagaatcctttggttcaacggtaaatggtttggtgacctcaattcggcaatttttaaattttataacatttttagaaatgggaattggagttgtaatttcaagctccttatacgaaccgctctttaaacaagatactgaaaaagtgagtgccataattgtttcgtccaagagattttttaataaattagttttatactttactttttttttagtagtgttggtttttacttatccattttttgttgtagaatttaattttatttacgtaagtatccttatggtgatactctcattaaatttgtatagtcagtactattttggaattgttaatcaacttttactaacagcagatcagaagaattatattcctcaggggctatcaatggtgactgttatacttaatactcttgctacagcagtgatagttaattattccaaaaacgttcatgttgtttttctttcaacatcatttatttatttagcgcggcctttattcatggatatttatgtaagaaaatgttataatattgattataatattagatatactgaggaaccaataaaacaaaagtttaatggtttttatcatcatctttcaagtattgttcttggaaataccgatattgttgtcttaactcttttatcaagtttgaaaaatatctcaatatattccatctatgctctgattttttcaggaataaagggaatcatttatgcacttgttacaagtttaactccttattttggcagggtagtttcaaaagagtcaactcaaggagttttaaaaaaatttagacatttagaatggggactcaatacgctcattacgttaatattttcagttgttgcagcttcaattattccgtttattacgttgtatactcaaaatataaccgatgcagattatattttgaatgaatttgcattatttatgtgcttatcacagtacatgttttgtatgagatatagttataatatctatgtacaatctgttggccattacaaagaaactcagatgagtgctattattgaggcaattttaaatattacatctacctttatttttacagctctttttggaatggttggattagcgataggcacattatttgcaatgctatatagacttctatatttacttaattattcaaagaaagttcaacttggtgctagtattattgggtctattttatatatttttacagggagttgtaatattgtagcaatgttttatatgggaagttatttagctcctaaaattaccacttttatgcatttggtttattatacaatgggttatgtctttttatctgttctatctcttttgttatgtaatataatatttaacaggagattacttttgggattctttaagtcattaattttaaaggatgaattataatatgaaaaaaagtattgaacgagattcaaaattagagttaattagaatttttagcatgttatttattgtatctagtcactatgttttgcatggcgggatagtgaacgaagtaacaggtttcgattttaatggattaacatcagactttttatatattggaggtaaaattggggctaatctttttattatgttgagtggctatctgttatgtgactgtatttataaaaccgaaagattattaaaaacagctctgataactttattttattcaactataggtttattacttggattgatagtttttaatgatatatctgtaatagatataataaagtccttttttcctattatcactgatagatactggtttgttactacatattttctgattctagtgtttatgccttatttaaactatgcaattattatcttgaataaaaaacaattggagttcttacttttattgggatttgttttatggtgctttattccaactttttttaatcaggacttaaatttttctaattttatttggtttatttttttgtatattttaggatctggaatgaaaaaatataaatttttatatgttgatacagctaagtcgtttataatatctttagttttttatttgttaatttttatttctatacagctattaaaattatgttctttacaaagtgaattttttgaaactaaaatttatttttttactaattcacatagtattttgacattcttttttacagttttctttttcaatgggatgctgtcactcaaaagttttacaaattattggctaaataaagtagcgaaagcaacatttgcaatctatttaattcatgataatgattttattagagagtggttatggaaagatttattgaaagtaagcgactatagacatagtagtatttttatttggcattatatttttagtatattgttgatatttttaattggtgttattctagagattttacgagaggtagtctttaagatgctgttagaagacaagattaagaagatttcaacaaattgtaatttaattcttagtaagttttttccagaataatataattaaggaggatggtttatcatgaaaaaaattttaatcacaggttcagctggtttcatcggtagcaacctagtattagaactattaaggagtgacgaagcatatcatattatcggtcttgataatatgaacgattactaccaagtatcgctcaagcattatcgtcttgaacagattgagcaacagttgactcatagtaaaagcaagtggactttcatagaaggagacttggcagacaaggatttggtcacttcaatttttgaagattaccatccgaatattgttgttaatttagccgcccaggctggtgttcgctattccattactaatccagatgtttatatagaaagcaatattattggttttcagaatatcttggaagcctgtcgtcactacccagttgagcatttagtatatgcttcatcatcttcagtttatggtggaaatgagaaggtaccgttttctacagatgataaggtagataatccagtatcgctttatgcagcaactaaaaagtctaatgaactgtttgcacatgcctacagtaagctttatgatattccaactactggtctgcgtttctttacggtttacggtccagcaggtcgtccagacatggcttattttggattcacaaataaactgataaaaggtgaagcgattgaaattttcaactatggaaattgtaaacgtgattttacctatgtcgatgatattgtggaaggtgtcaagcgtgtaatgtttggtgcaccgcagaagagaagtggaagtgatggtctccctattccgccgtatgcaatctacaatattggcaatagcaatcctgaaaacttattggattttgttcacatattgagtgaggaactagttttggcaggagtattaccagcagattttgatattgaagcacataagaaactggtacctatgcaagctggagatgtaccagtaacctacgctgatacttctgatttggagagagattttggtttcagtccctctaccactctcagagaaggcttacgccaatttgctcaatggtataaaaattattatgcataagcactattttcttgtcttgtaaaggaaagaggaagtaagaaatgaaaaaaatcgccgtcgcaggaacgggctatgttggcctatctattgctgttttactagctcagcatcatcaagtcacagctgtggatattatccaagaaaaagttgatttaatcaattctaagaagtctccgattcaggatgattatattgaaaaatatctagctgaaaaagacttaaatctagttgcaacgttggatgcagaaaaagcctacaaagatgcagaaattgttgtaatcgctgctccaactaactatgatagtgctaagaactactttgatacaagtcatgtcgaagcagttatacaaatggtattatcggtcaaccctcaagctttaatggttatcaaatcaacgattcctgttggatttacccagtctatgcgtgagaaatttgctacggacaatattatttttagcccggagtttcttagagagtcaaaagcactttatgataatctttatccatcacggattattgtatcttgtgaagatggtgcgccagattcggtagtagaaggttcaaagttatttgcttctcttctacaagagggggctttgaagaaagatgtggaagtgttgcatatggggtctacagaagctgaagcggttaagctttttgccaatacctatttggccttgcgtgtttcttacttcaatgaattggatacctatgcggagctaaagggattagatacagaatcgattattcgaggagttggtttggatcctcgtatcggcgatcattataataatccctctttcggatacggtggctactgcttgccaaaagatacaaagcagttactggctaattacaatgatattccgcagaacatgatgacagctattgtagagtcaaataggacacgtaaggattttattgctgatcaaattttgaagatagctggttattatgattattcgtcacatgatcaatactctcaattgggagaaaaagaagtaatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacacctagagaggacgaaattcgttctctcatttttgatgtttaaagcaatatatatcttggttttaaagttcctaaagccgaacgcttgcctcttgatgtctttgatgagtttattggtcgcttccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgccagtgatttttcatggatcgataaggtagggaacgcgtatcgaaagtcttcataatatcaattctagtcgtcatcatagcacggctcaggtattggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtggtttggcggttgttgtcaagaatggtcacaatcgatctcgtctcaaaattctgagcaataaaggcgagttttcccttgttccgactaaattcatcccagctcaagacttttggtaatttcgtaaaatcatgctccaattgaaactgagccagtttcctctggacgaccgatacggagatatgtaatctcctagcgatggctatattggtcatgttttctgtatggagttgagagactttctcccaaataggtagggaaatctgacagtttttcttgactagagctgtctcagctacagtcactttttggcaagatttgcattgaaaccgccgtttcttaagcaagaggagggtcggaaagccctgacaatccaaaatcggaatctttgacgacttttgaaagtcgtacttgatacactttccttggcaatgaggacaaccagggctgtcgtaatctagctttgccctgatttctagatgggtctgatgtttcaaaatgaagagaattttgatgtttttgtctttgattccaattagttctgtggtatgataaagttgttccatatgagtctttctaatgtgagtgtggttgcttttcattataggtcatatgggactttttgtatatactcaaaaaggctccataatctctacagtggatttacccactacagaaattatagagccgaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaacaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcttcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacacttggttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagaaatcagtgtataaaattaataaatttgaaggtgaaatctatcagaagttaaataaaattcttgattcatataaccaagaacagaatagcctgataaaccttgctgcatgtattagctatccattcaccgaagtattaaagattcaaagtttccctctcgctactctgccaacagagggagctgttgaaaaacgcttttttcctcattgtacttcattggataatattgaagtatattcagaagaattgtgtcttcaactttttgatttaaatcctggtgattatagagttaatgtgcaaccacattcaggaactcaagctaaccaaatagtctacaattgtgttttagaaagagacgattatattttatcgttatctccaaaagacggaggacatatttcgcatacttatacaggtaaaggtactgtaaaatattatcacttagaccataacttaaatattgattatatcgaattaaaggaattattagataaatataaacctaaattgattattattggtgcttcgtcgtatggaaatgaatttaattatcaacaaatttatgaaattataaaagaggttagcccaaataccctcatcttagcggatatttgccacagtgttttatatattatggcaaagctacataagtcgatttttccatatgtggatttcgctacttttacaatggataaatgtttacgtgggcctcaaggaggagtactactgtatcgttctatatttgaagaaaaaataactaattcaatttttcctagaacacagggtgggcctacacaaactgcattatttgcgaaatgtatctgtttaatcaaattattatcaatagatattcaagattatgctaaacagattataaaaaatactttattgtttataaaacaattaagtaaagagggggttgatgttgtttataaaaaaccaaagactcatataattttagttaatctattgaatctaaacttgagtggtaaggaggcagagaatctactttttcagcataaaatattagttaaccgaaatcaaattccaaatgatacacacggaccaatgacgacttcaggaatgagattaggaacagttggaattacaaatttatcctatactgatgaagatataaaaaaaattagctaaactagtagctaatttattaaaatataaacaatatgattattccatatatttagatctcattcacaagtaccatgaacaaattaatatctccaattaggagaaagacctatacagaaattatattttttgtatggaatcaacagatagtatttggtgagcccgtcttgataatcatcaatataagttttttcataaacaaaaggaatatcttcaaattgttgtaaattgtatactatttgaaatttataccaaggatcgtctatgagtggaatttctgcctcaaagctctttagtgaattttgaaattctgtaaaagagattttttcagaaatcaactcaataattaatttgtttaacttgagcatcctaatatctaaggtcaaagctttaggacattcttgaagtgatttatttataaattccagagattgttgataatttttattcatcagaaaaataattgatttattacaatatggttcaaaaatttcatttgaatcatatttttttagtattttttcggccttatttatattctctaaagctatatcatattgcccatcccatatattaacaacacctagattattatatactgttgcaacaggtatttgatattcattacgttgaaaatagtccaatgctaattcgagatttttggtagcttctttggttgggaaataatgagcagaatttcgtaaaataatataatagaagtcgtctttttctacagaattcatggtctcattaaggagtttaattgcatcttgatctttacctaaatgaccataagcatttaacttgtagagtaatgttccagagctattttctaacttttccagtgattttagtgcctcctcaaattcatatttttgaatttgaaatctaggatagtatagttgtaaatcttttgaataattatcttgttgaaggctatttaaaatagctaagcctccattgaaatcagaaatccactggtacgagttcaatatataatgtaagtatttttatggtaataattctattaaatgatgtatcttcttgctcaaagatgcaatgtaaaaatatgaatttttcctgtattctatttcaagtaactgtttgatatattctacattttgtcgtaactctttaatattacatatatttattaagcagtgaattaaataagctaactcgccaccaactcctatagataagatagtttgctctaaatatatttttagattgttggttactaattgaagatcagaagtatttgtgtgatttaaaatactatttacaattgattcgtgtgaaattttgattttatcatttgtatctccattaatatatacgaaacctgcatcaataagggattttagagaatcagctacttcaatattttcatctactatagatttaatgtaattaaaaactatatcttttctcataccagcaggaaaaattgatgatatgagaagtatatttttttgaatatctggaagtttgtcatatatatcagaaatattaaataattctgaatttggattatcaataagtctgttaataatcaattcaatctctttatagttaccttgtgttatctgccagatttgattcaatttgatattatcaagtaaagcaattttatttcttattagtaatttacactcatcctcagtaagatacgataaatttaatacagtaggagtataattgtccaatgtatctagtttatcaattgattttaacttatcagttgttcggtttataatagttaaggagactccgctttgaagtgtattaaagtcatcttcaaattttatttttatatcttcagataaaaattgataattatcaataataatattcagacggattttttttgaaacatgactgaaatatcttaaatataaatcactttcaaatattccctcctttatttcagtaacaacttcttcccaaggataatcaattacttttttataggttgtatcgaatgaaatcaaagatctgattaacctaaaactatgtttcagagttagatttgttagtttttgttttcttaaataatttgaaaatgaatatttttgaggtattgataagcatagatttcttctgaattgagttgggacatacgctccttttagtagattttcaaaaaatttattactttcaaacccgtcatttgtaacatcaatgtagagaataaacgcttctttatcatgactgtaaacttgttgacaaacctctttgattaactcggttttaccactaccacttaagccattaataatatataaactatttttatcattactggaaaatttaaaatgctgttttaattcttctatttcagtatcgcgaccgtaatacataaaacatctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaac

SEQ ID NO: 39 - DNA, 32503 bp, Streptococcus suis
gagatttattgtcaaataaaaaagtaaaattggaaatgagaatattatgtcaaaatggaaaattgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtctgcgtgcccaagtccgcaggcttatcaggcagcttttgagggagctgagaacattatcgttgtgacgattacaggtgggttatcgggtagttttaatgcggcacgagtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggaggtcgaattgtcatggcccaccgcaacaatgctaagttcttccaacaattctcagagttggtcaaagcaagttttccaacggctgttattgacgaagttgcaacatcaggtctatgcagtttttatgctgaagaaggtggacttttgatgggctatgaagtgaaagcgtgattcacagagtaacgattttgggatgtaatttccactatagaataatccccctcgtcttttaagttcgagggggattgtttgtatgagactgttagatttcattcattcaaatatcttacgaattgctccagtttatctgcaaaatcttgttcaaagaagatctgtaagaaatcagctttctgtccgctgaaataataatattttccaaacatgtgttggatgctaggagaaaggatccccttgcttagctgaaaggtcacgctccctttggaaattcgatacgggatgttcaaagcgtatttctctagacaatcttttattttattccactgagcgtgataaatgtgatgaagatgctgtgtgttccgtgcaaacataccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatgtagatgacacgattatctgtatcaagatagtgtaaagggaggctatgactagagtcgaaatccgccaaatagtcatcctcaatgatgtagacattgtattgctttgctaattttacgatggctgtttttgttgctatatcataagttgaaccgagagggttgtgcaagcgaggaattgtgtagaaaaacttaatttttccagtttggaagatactctccaattcttctaggtcaattccatctaaatcccgttcaattgtttgataggggattccttgatgtcgaatgagctctatcattcgtgaataggtagggttctctatcaagatttccgttttgccagccaaggtttccatttgtgtgagaatatatagagcttgttgactaccagctgtgataaccagctggtctttatttgtatagacatgatagtccattaacagactttgaacggaggaaatcaattctgccaatccctcttgctggtgatagtagttgaataggtaattttcccgcccaataagactttcgtttagacaaatccgaaaatcttcatagggtaattcttgaaagtctgcaggattgagctctacagtttggtcttggaaatctctatcttctaagatataataaccgcttttttcgacagcgtagatcttattttgatactttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagctagtatataggaaaaattgaagaaagacaatatatgaataatggggttgaggttcaggaattaagctactctatggtataattaagtgatgaaaataattatacctaatgcaaaagaagtaaatacaaatctagagaatgcctcgttttatcccctgcctgatcaaagtaagccggtgctggataccataagtcaatttgatgtaaaaaagatggctaccttttataaattgaatgaagcaaaggctgagttagaagctgaccgttggtatcgaatcaagacaggtcaagcaaaaacctatccagcctggaagttatatgatggtctcatgtatcgttatatggataggcgagatatagattcgaaagaagaaaattacctacgtgaccatgttcgtgttgcgacagccttatacggattgattcatccttttgaattcatttcacctcaccgcttagattttcaagggagcttaaagataggcaatcagtctttgaaacaatactggcgaccgtattatgaccaagaagttggtgatgatgaactgattctctcactggcttcgtcagaatttgagcaggtgttttctccacagattcagaaaagattagttaaaattcttttcatggaagaaaaagcagatcagctaaaagttcactcaactatatcaaaaaaaggcagaggaagattgctgtcctggttggctaagaacaatattcaggaattatcggacattcaagattttaaggtggatggctttgaatattgtgcttccgaatcaacgggaaaccaacttaccttcatacgattagaatatgaaaaaaatagaaaaaaattaacaagataacattttatgatacagagcatatctagaaaaatcttgatttctatggtataatggacaagttataagtaaaaaggaaggttgtttatgaaaaagagaaacggatggaggaagtcgtccaaactcaaattggtaaattttgcgcttttagggctttacgccattactctatgtttgtttttagtgaccatgtatcgctataacatcctagatttccggtatttaaactatattgtgacgcttttgctagtaggagtggcagtgttgactggattattgatgtggcgtaagaaagcgcacatatttacagcgctcttacttgttttttcactggtcatcacgtctgttggaatctatggaatgcaagaagttgtaaaattttcaacacgcctaaattcaaattcgacattttcagaatatgaaatgagcatccttgtcccagcaaatagtgatattacggacgttcgtcagcttactagtattcttgctccagccgaatacgacaaagataacatcactgctttattgtatgacatatccaaaatggaatctgctcaactagtaactaatccctcaacatcttatctgacagcatatcaatctatgttgaatggtgagagtcaagcgatggtcttcaacggagtttttaccaatattttagaaaatgaagatccagacttttcttcaaaagtgaaaaaaatatatagtttcaaagtgactcagactgttgaaacagctactgagcaggtgagtggagacagttttaatatctatattagcggtattgatacctacggtccaatttcatctgtttcgcgttcagatgtcaatatcattatgactgtcaatcgtgcgacacataagattttattgacaactactccacgagattcatacgttgctatcgcagatggcggacaaaatcaatacgataaactaacacatgctgggatttatggtgtcaatgcctctgtgcacaccttagaaaatctttatggtattgacattagtaactatatccgactcaactttacttccttcttacagttgattgatttggttggtggtattgatgtagaaaatacccaagaatttacaagtttacatggaaattattattttcctgttggccaggttcacttaaatgcagagcaagcgctaggttttgttcgggaacgttattcacttgagggaggggataatgatcgcggtcaaaaccaagagaaagtcattgcagccctcataaaaaaattgagttcaccagataatctagcgaattatcaagctattctaacaggtttggaaggatctatccaaacagatttgagcttagaaacgattatgggcttggtaaatactcaattagagtcaggaacacaatttacagtagagtcacaagcattgataggaacaggacgctcagatttatcctcctatgcaatgcctgggtcacaactttatatgatggaaattaaccaagatagtttggagcaagcaaaggcaacgattcagtcagtattagagggaaataaaaaataggagtgattatgaataatcaagaatcaaatacaatcgaagttgatgtattatcattgttgaaagcaatttggagaaaaaaattcttcattcttatgacggcagtgttaggtgcaagcttagcatttatctatagtaattttttagtgattccacaatatgattctactactcgtatctatgtagtgagtcaaaatgttgaagttggtgcgggattgacaaaccaagaattacaagcaggtacttatttggtgaaagattacaaagaaatcatattgtcgcaggatgtattgtcgcaggtagctacggagttgaatttgaatgaaaacttgaaaaaaaaagtttcagtttctattcctgttgatactcgtatcgtttctatttccgtgcgtgatgcggatccaaatgaagcagcacgtattgcgaatagccttcgcacctttgcagcgcaaaagattgtcgaggtcacaaaggtaagtgatgtgacgactcttgaagaagccgtaccagcgggaactccaactactcccgacataaaacgaaatcttttgctcggtttattaattgggagctttttggcaacaggacttgtactggtagtggaggttttagatgaccgtgtcaaacgtcctcaggatattgaagaggtgatgggcttgatattactaggagtagtaccaaattctaggaaattgaaataggagaacaatatgacaacgttagaaattgcacgtacgaaaaaagaattgataaacaagacagaggaatatttcaatgctattcgtactaatattcagctcagcggttcagatatcaaagtagttgggattacctctgttcaatcaaatgaaggtaagagtacaactgcggctagtctcgctattgcctatgctcgttcaggttataagacagttttggtggatgcggatatccgaaattcagtcatgtctggcttttttaaaccagttaccaagattacaggattaacggattatttggcagggacggcggatttatcacagggattatgtgatacagatattcccaacttgaccgtcattgagtcaggaaaggtttcacctaaccctactgcccttttacaaagtaagaatttcgaaaatttactagctactcttcgtcgctattatgattatgttattgttgattgtccgccattaggactggtaattgatgcagccatcattgcccagaagtgtgatgcgatggtcttggtggtagaggcaggcagtgttaagcgttcatctttgaaaaaagtaaaagaacagttagatcaaactgggacaccattcttgggagttatattgaacaagtatgatgtggtcactgaaaaatatggtgaatatggaaattacggcagaaaatgatttcctcttgatggtataagtttgataagtaggtatttagtatgtttgatattcattcgcatatcatatttggtgtggatgacggtcccaaaactattgaagagagcctaagtttgataggcgaagcttatcgtcaaggtgttcgctatatcgtagcgacatctcatagacgcaaagggatgtttgaaacaccagaaaaagtcatcatgactaactttcttcaacttaaagaagcagtagcagaagtttatcctgaaatccgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgacgctacttggactaactcccgtacttgctcatatagaacgatatgatgccctagcgtttcatgcagagagagtagaagagttaattgacaagggatgctatactcaggtaaatagtaaccatgtgctgaagcccgctttaattggcgatcgagcaaaagaatttaaaaaacgcactcggtattttttagagcaggatttagtacattgtgttgctagtgatatgcataatttatctagtagacctccgtttatgagggaggcttataagttaataacagaggaatttggcaaagataaagcgaaagcgttgctgaaaaagaatcctcttatgctattaaagaataaaacgatataatataaaaatacgaggagacaatgtttattgatgtaaaacaccgccgaatacggcttttattaatagacttaataagtgtcattatttcagcaagtattacaagtcaaattccaaatgcagatttaagtcgttcagggattttaatcatcttaatgattcatttttttgcgttttatatatcaaatttgtatgctgattttgaaaatcgaggctttttaaaagaatttgaaaaaatatttttgtatagtcttgtgtttgctattctattaacagctgtttctttctttttggaaaataattttgagttttctagaaggggactgatctattttactcttatgaattcagtttttgtctatataacaaactgtactattcggagctacaaagattatatttttttaaattcagattatcaacataaaattattttgctcacaactctggagcgttggcaagggatgaggaagttattagagtcaaagaaacttttgcaaaaaaatatagttgctcttgttattctagatatccaagacaaagagtttggactgtcaataccagtattcaattcagtggaagatgccgtcgggtttgcaaccaggggtgttgttgatcaaatttttattaatttgccgagtgaatattatgatttgaagcaattggtttcagagtttgaaatactaggtattgatgtaagtgttgatattaattcatttggatttaaggaattaaaaaataaaaaaattgaattactaggcaatcatagtattgtaactttttctactaatttctatgaccctagtcatatttttatgaaacgtttattggatataataggcgcaataattggtctagtattttgtgggttagttgccatcattttagtaccactcattaggaaagatggtgggcctgcaatctttattcagaaaagaatcggaaaaaatgggagaatttttaaattctataaattccgttccatgtgtattgatgcagaaagacgaaaaaaagaattgactgagcaaaatcagatgaagggagggatgttcaaagtggacaatgaccctcgaataactccaattggtcactttattagaaaaaccagtctagatgaattgccacaattttataatgttttgataggagacatgagtttggttggcacccgcccacctaccatggatgaattcgaaaattatacgcctagtcaaaaacgccgattaagctttaaaccaggcatcacaggtttatggcaagttagtggtcgaagtaatattacggactttgatgaaattgttaagctggatgtggagtatattgataattggaatatatggtcagatattaagattctattgaagacaatcaaagttgtattcttgaaagaaggaagtaagtagaacttctgtaaaacatagaggagtgtaaaacatagaggagaattatgagaacaatttatgtcattggttcaaaaggagttcctgctgcatatggtggttttgaaacctttgttgagaaattaacggagaatcagaatagtaaaaatataaaatattacattgcatgcatgagggaaaattcagtaaagtcagagataataggtgatttctttgaatataatggtgcaatttgttttaatattgacattcctaatattggaccggctaaagcaattatgtatgatatcttagcgcttcaaaaagctattacaattgctaaacaaaatgatgatgaaaaaccaatattttatattttagcatgtcggattggtccatttattcatcactttaaaaagcaaattgtgtcaattggaggccaattattcgtaaacccagatggccatgaatggttgcgtgaaaaatggagctatcctgtccgacaatattggaaaatttctgaaaatttgatggtgaaatatgcagatttagtgatatgtgatagcaaaaatattgaaaaatacattcgagaaaattatcgtaaatacactccaaagacaacatatattgcttatggaactgatgtagagaactcaggcttaaattcaacagatagtgtagtacgagagtggtttattgaaaagaatatttcagaaaacttttattacttagttgttgggagattcgttcctgaaaacaactatgagactatgattcgtgagtttatgaaatctgagacaaaaaaagattttgtcctcattactaatgttgaacaaaatgctttttatgaaaaattaaggaaaaaaacgggatttgatagagatcggcgaatcaaattcgttggtaccgtttataatcaagaacttctcaagtatattcgagaaaatgcatttgcatatgtacacggtcacgaagtaggaggcactaatccatcattattggaagcattagcttcaacaaagttaaatcttttattagatgttggcttcaataatgaagtagcggaagatggagcaatttattgggccaagaattcacttcatagagttattgaggagagcgaattgttaacacaaaaagaaatcgaagaaatatccacaagagccattagtcaagtgactaaacgctttacatggaaatccatagttgatgagtatgaaatgttatttagtgaggtgaaatagtattgaaagtcggagatagcacaattgcaattatgatggctacatataacggtgaggattacttatctcaacaaatagattcgataatttctcaaacctacaaagattggatcttatttattcatgatgataactccaaagatcttactctagagatattatctaaatatgaatctaaggttgaaaacatatatgtgattcgtgatcctgaagttattggcgggagttcgaaaaagaactttgcagctattcacaaatggttaacgaataattttgattttaattacttcatgttttgtgatcaagatgatgtttggttggagtctaaaatcgaacattcattgaaattaataaaagaatctgaagaattgaatatgaaaccacttctagtccatactgatttaaaagtagtagatgaacagttgaatgtgcttggaaattctttcttcaaatatcgcgcattggatagtaatattacagacattaatcatttattaattcagaataatataactggatgcactatgttatggaataaagagctcaatatgttattgaatttgcacacttcatcagttgttatgcatgattggtggattgcattagtagctagtgcatttgggaaaattttgtttttaaatgaatcaacaattttatatcgtcaacatgggaaaaatgttgttggagcaacaaaagtaaatacagcatcttttatttttagaaggttactaggcaattcaagggtacgtgaagtattattgaagtcatttaatcaagccagttcatttctttcagtttttggtgatagattaactgataaaaaccagaaaattattaatgcttatatcagcatacctagtaaaaataaatttcaaagagtgcgcttagctataaagtatggattcttaaaacaaggtcttattcagataataggagagttcatttttatttagtatttgataggattgagatgaggatattttatgaaaataaattttattttaccatttaagagaatgacaggtggtataaaagtagtttatatttatgcaaactaccttgtcgatcagggacatgatgtagtatgttatgttccaatggtgagctacaaagggaaagaccagtcaattttttatagagtaaaagcttctcttgggaatacaataaaaaaagagaggtggttcgagaaacaattcaaactccaacttgttccgataatatcagaaaaatttataagagatgcggatattactattgcaactgcatggcaaactgcttatgatgttaatcaattttctgaaaaaaaggggaagaagttttattttgtgcaagacttcgagacgtttaatggtaaacaaagagaggttgaaaattcctacaaacttcctttaactcttattacagttaccaatagtttgaaaaagaaattaaaggaatttaattcaaagaaaattcatgttgtatacaatggtttattcgatgaagactattttcacggagaaaagttacggtctcccttgcctgtactgttaatgatgtaccatgaaagtgaacataaaaaaactcaggatggtttggaggttatcaggagagttaaggagaagtatccggaaatagtagtcaatatttttggaagaagaataccagaaaaattgcccgattcctataatgttttaatcaatcctccaagggagaaaatttttaaaatgtatcgagagtcggatatttatctgtttacaagtgagatagaatcatggggtctcccagttgtggaatctatggctaataaagtagctgtaataggcagaaatcgtggagcactagctgagttgtacaatggtaataatgcaacactttttgagacagtcgatgaattatacgatttgattattactcttatcaatgagaggaatacgttgcaacgattacaattagaaggctatgaaacagtaaaaaaattaaattgggcagaatcaagttctcgatttatgaatattatttttaacggtaataagaatgaatagattaaaaaaaaggatggcatttttcttggttgcaacttggtttttaattatgattgcactctatacaggaagaggtatcaatcagttaatcattttactgtcgttgtttgctttgtttaaacaggtggcaagtagagacagaatcgtgttatctggtgtctttctacctgcaatttgctttattgcatattatatacttattagtattttaaatgatacagagatttctatagtaataataaaactaatgctattaccatttaccatccaatcctttatcccaaatggttcagaaaaaatcattgtattaatagatattttaaaaaaagtgatgggaattgttggtgttttcgggataattgaatattttcaacactataatcctttggttaatatcgtaaaaattaatcctgtattatggctagaagccatgaacaatactctcgcaaattaccgaccaagctcactatttttacattacacatattttgcatatgttatgctaattgcattttgtatttctttagtatttccatataagaatagtttgaagaatctattatataattctatactacttgtttcaatttttctatcacaatcaagaattatttggatagctgttgcagggattattctactaaaatttatgattgaagataagaaggtttcaaaaaataaagctttaatatctatattttcaattgtatttatttttactgtatttggcggagtaatagaagatattataagcgtaatagaatctagatttttttctatttttaaattcggcttgctagatggttcatttgggcaacgagttggtacattgctaaattggttcacgtatcttggtgataatatttttaaaggaatttttggcggaggatacggcagtactagtgagtatttaatgacaaattcctactttatgggatataatactgtggattcgacaattactactgttctagttgaaacaggtatagttggtagtgtattgttctttatcgctatagctagtttgttttatgtatttattaaacgtttaaataaaatgacaaaattgggattatatgtattgagttctacattaatcacttcaatcactattgattttttagctaatgacgtgatactttatttattttatatggtactaatagtagtactgcgcaatattcaaaataatgagcagtatggttagtggaatatattcacggttctagttaagttcaaaatagattagattattatagaacagttatttgtgcaacttctactaacagtataattaatcctcttgcagccgttgcagatgttattaatctccgtggtgctagttaatttcaaaatacaataaaaagcccaaatggactatactgtaagtgatgaaacatacaggaggttagttccaaatgagccacttacagtacactgctaaatctcatcatttgcaatggaatgtacgccaattatctcaaatttgtcatcacttctaccaaaactattgcccagattccttcaaacatcggcgtaatgttggcttagtcaaagtttcagatgaatcgctccttgtcttgcttttgttacaagctgaactaggcatcacaacacaacaccatttctataacatctgccgcctctttccttgcagtcagttactagaaagaagttattttaatcgtcgatctaggcaattgatttgactagtccaattaatccgaaaagttataagtgaaatgcttagactagccatcatagatagttttcctttgccaacctgttcgtaatcaaagagttaccatttttaaaggattagccgatattggctacagcgcctctaaacatttttgattctacggttttaaggtccatatgcttgctactttatctgaaactatgttgtcacatccacctctgtccaggatatcaaggtggtttatgaactattagagggatgtaagcaatcagttatcctaggtgatttaggctacctaagtagtgaactcaaaaaggacttagagtaagaaggttaccatctatggacgccgtttcgtaaaaacatgacagggcccgaagaacataacaattagaaagtaatggccatgagacgaactattgaaacacgtttttctgaaggggggcgtctctttgacatcgaacatacattagctagaggtctggccggactacagttatgaattgaacaaattattctagctcataacttacgatactttgaaattaactagcaccatggattttattaaggtattattgtaatttgattcatggttcaatttactatatcgatagagatttttctggagcgttagataagctgacattatggtggtacttcagcgattcaagacaataagtacgacaaggttgctgaaaaaaattgaaaattgcttcatacttcatcgtaaacgatgaaagttatccaaatattgtaagaggattatctctaccatcttttgtctgtttcgtaacttgcagtatattctattcttagctagttactatggggaaaactaatattgtgtgaagggaatatctaaaaattgagaataagcttgtgtgattcaatagtgacaatatttgttattacaagaacaacattaaaatgaagaaaataaggctagtaacaacaataatgaggggaaagatggaaaaaattagcgtcattgtaccagtttacaatgtagaattgtatttaaaggactgcttggatagtataatttctcaaacgtatagaaacttagaaataatattagttgatgatgggtctaccgatttatcattagaaatatgtcaagaatatatagaaaaagatgctagatttaaactgtatacattaaaccatcaaggagtatctgtagcgagaaatgaaggaatacacaaaagtacatcaaaatatataatgtttgttgactctgatgatataattgaaaataatttagtcgagcttttatatgagaatatgataaaaaaagatagtgatttatccggctgtctgctttctacctttgtacacgataaagaaatccttgagactatgcgtccaaagattaatttaaatacaatagtaacagtatcaaatatgggaaatgataattttgaagagctatataataaagggattttttcaacacctgtatgtaagttatataaaaaagattatatagtagaattattcgatgcagaacaatggtttggagaagatttaatttttaacttgaactatcttcttaaaataaagagagttagctatattgataaagatttatattggtacagaaaagggattaaaagtacagtcagtacgtttaaaaatgatatatttttacaggttgaaagagtatatgagttatcgatggctttatttacagaactttttggctcagaatatgatttatcagtactagaaaaatcggctaattggcaatttttttactatggtttattaatgtttaaacatggaaagcaatcattttttgagaaaataaaagttttcagatatttttatagtagaaggaaatttaatatttttaagtatacactaatattcttttttaaaaatattttattatcatggtcattatataccaacagactaattaagaggagatctaactaacatggccattgtttccataatcgtcccaatctataatgttgaaaaatatttaagtaagtgcattgagagtattttaaaacaaacgtatgaagatatagaaattcttcttgtgaatgatggcagtacagataactctgagttcatatgtttagaatttgcgaataaagataatcgtattcgttattttaaaaaagaaaacggtgggttatctgatgcacgtaactatggcatagaccgtgctaagggaaattatctagtttttgtcgattcagatgattttttagagtcagaatttgttgaacaattatttagagcaattgtaagagagaatgcgatggtagcaattactggttatgatagagtggatgctcaaggtcattttttaagaacagaaaggctttccactaacaaatctattttgactggtagagatatttgtaaaaagatgctagaggcagaaggtcatcgttttgtagtagtatggaataagctttataagaaagagttatttgattgtcatcgttttgaaaacggtaaactccatgaagatgaatactttacctatcgattactttatgatttagaaaaagtagcaattgttcaggaaagtttgtatcattatgttgaacgagaaaatagcatcacaacttctaatatgactgaacatcgtttccgttgtttgattgaatttcaaaatgaaagaatgtgcttctataaaaatataggagatagagaggttttactagagtgttattattcgtttttaagatttgcaatttggttttcatataaatacaggcagtggatgactgtgaaacaaaagaagtttttgcaaaaacaatatcgtaaagtatttatagatatgatgaacagcaatcaagtaagtttggttaaaaaattgtattattctgttggctatattaatctaccgctcatagttattgtaaagttagtattgcatcagttatctttccaaaatcttactgagcgcaaacgaatctaatattcatattaaagtataaaaagttttcgataaaataggtgtgtttatatgcaaaattcaaaatatacgagcaaaacaaatgtatacatatgctatacgctctatcatttgttagtttcattaatttatagctctacaatgaatgataaaaagtctaaaattgttatattaacaagaatagcaaatgcggaaagctatcttaaaaaaattcagtactactatccaattatagatgtagtagttgtggatgatgagttgttcaagaaaaaaggtttcttttattctaaggaaattcatcaactctatcagtatgtaatcggagatggattaattcatatctttaatgattggacgcagattggttattatttacatcgtaatagaatttcttatactttgatggaagatgggctaaactgtatgcatcatcctactagcgttccaaaatggacgtttagaactatgattagaaattgcctagaaaacacaccgaactggaatggctatagcccatactgtacttcaatcgttgtaaacgaaataacaggtataccgatggatagtcggtatccaaaatttgtggaagtttccaagaaggaattattgtcacaactctctcatgtggaaaggaaaaagttgttgttggtatttggagggcaaccactagttattaaagaacctgcggtcttaattctgacacaacccttgtttatggaattcccagatgacacaaagaagagagaattttggggaaatttaatacacaaatatagtagcgaaggataccatgtttatgttaaagtgcatccaagagatactcttagttatacaatctttccagtgactattttacctaaacatttaccagcagaattacttgattttatcgtagacaaacagtttgcaataggtgtaacctattactcgactgcattggaatatatggactgtgtgcaggaaaaagtatatctttgttgggaaaagtaatatgtttcattaataaacataaaattgtaagaatgagggagaagtgtgtccgtttcaaaattagttaaatcaggttttatttatacactaggtgcggtactgatacaggggctttccttaattactacaccaatttatacccgtatcatttcacaagaggtgtatggtcagtatagtttgtataactcatgggtggctttaataagtctttttattggaatgcagacagttggatcattgtctattgcaaaagtgaaatacgcagatgagtacaatcgttatgttgcccatgcgctttctctatcgactcttgtttttctgactattttttctctagcatttctatttaaatcttatatttctatatatattgaagtttcagagccgattgttttattgatagtgactcaaagttttattgggtatgtagctggatttcttggtcagtactttattcagcttcaacgagctaaggagaatttacttttatctgctatagttgctgtttcttctgtcgttttatcactttatttattgcaaattatgcaagatgattttttagcccgcatttatgggggacttttcccagccataggcatggcagtagtaacttatttttatatttatacaagaggacgaaattttgtcagaaaagaatatatacgcttcacattaacaatttcccttcctcttgtatttcatcatctgggaggtcaattactggggcatttgggacgtattatgataggtcagtacatgactagtcgagatgtagcactctatagttttggtagtagtttgggagcaatcattcagttagttcttgggaatattaatatcgcttgggttccttggcactttgaagctaaacgtacaaataatcccgatctttctcgatatgtttttaactttctatctttatctcttttcttaacgttgggctatctaacaatttttcctgaattagcatttttgatgggaggagaaaaatattcagatagtatagaatttattgctctaattatttttagtcattttttgggatttctctatactttccctatgaatattcagttttatcatgggaacactaagtttgttcctgtagcgacacttgtttctggatttttaaatggagctcttaacctctacttcattccgaattatggaaacaaaggcgcagcaatggcaactactatttcctatatgacacttgtggtgtttcactatgcgatttcaaggaaagtatataactataatgaggtatcattgcaatttttagttgttttatcagcggtatcaggtggctatgcatacttgatgaacttttttattacgagtctctgtattcgttggtcaattggattcgttgttataattatctacaccctgatcttccgaaaagaacttgaagcaattctctggaaatttaaggagaaaagctgagagtgcaacacttttctctaccaattttataaagtgtttttgttttgcgaatgttttcatggttaggggatgaattaagactgttatgtatgcagaggtagttccaccagtgggcataatccttagtttaaggtgcaattcttctaacgaacagaaaatttcttggttgataaactcaaaatcaaagaagcgatagttagtctcagctacggcattgttgagacaattacactaactaagagatttggttcccttgtttcagatgacatagttacttttgaattactcatgaatagccctctttcaattatttatggtgataagggacatgatatatagatcaacaagtgaaatcaaagttatctcaatctggcgttgagttgttatcgcaactaagtaaaaacatgactggctattcgttgcttgacaattatataataagccgtccaagaacgctcatagagattgtattttagagtttatagcagtttggaacctagagcttacattgttgacatttaagagcacttaaagttcggatagcggcgatattgcttgactattctcaatcataatggatttggtatgagtttgaaatattcctgtgcttatgtctaattaactagtacactgaataaaaatatataaaatagataggagaaatttatgattaaaagatttttttcaatagataaagttcaccaatttttacaaaataagtttactgcaaatagagagatccttttggtatgtattttgtatacatttttattcggacttgttgctcattcatttatggcgttgaatagttcattttcacatgattctcttccagaattatttgcagctaatgagtggaaactaaaactagggcgtgtttttgctccgatatatatacaagttagaggggagataactttgccatggttgatagtacttcttggactagtatataattcactctctgtatttttgcttacaaaaatttttaatataaaatccagatgcatgatattctttatttcaggaattttaacagtaaatgtgtcttctattgcccttatttcaagttttatccatgagtttgataactatatgttatctatcttattatcaatattatcagtatatttatggaaatgttatgaaaaagggtacctatatggagcggtttctctcggtttctccattggaatctatcaagcttatatttctgtagccattagtttaatcgtcttttattttttgttagaactgttagaagggaaaaaagtatcatccctgcttaagagagggataacaagcatagttatgtttgtttttggcggagtgctatattatttatctttaaaagtagcttttttactcacaggtataccagtacgaacaggagcatataattccctagatacgatttttcacatgtcattcgttgagattctttatacaactgtgagagcctatgtgaatatgataaggaatattatattttacaagtctatagctccaagattgataatgtttgctttacaaattattttatttacatttggggctatttcttttctacaattgcttttaagagaaagagtaaaaactagagaaaaactgctttcatgtttcctagtacttttgttgcctttagtaatgaatatcatttttatacttacaaaaggttctgtacatgacttgatgttatttgcgcattggtttgtttatatttttttaattattatatgtagaatggctgtagatagagaaaagcatcatgacttaaaattcttcaatttacaacctgctgttatgatgtttacatttttactgctatggataaatattgtcactggtcattcagtatatctaaaaaaagatttggagcataaagcaagcatttcgctattaactagggttttatatcagatagaaatgcaggataactatgttaccggtgaaactcccgttgtctttgttggagaacctactacactgcttcctaaacagaacaaattctctcctctatatgaaattgaaggaaatcagaaaacatttattataacaagatggggaaagagatggaaaacacaaagtacatttcattatcttctaaacaaccctatattacttgttgaagaagaacagtggaatgctatgcagaaggattcaactattgaaaaaatgccaatctatccagaaaaaggtagtattgcttttgttggggatgttttggtagtaaaacttggcgagtcacttgataattagatttatctattttgggaatattaagttggagtgattgacaagaagatggtaaagaaaacatatattaatattaaagtcgtgggttgaaaggataaaatatgaaaagaatctatatttgtcatacggtctatcaagttttaatctccttattaaagatggatataaaaaatgatacattgctgtctgtgggaattgtaaaaaactttcccaatatgcgtaatgagttgatggcatatgttaatctggtagaggttgaagaatatacatttggactccgttcaatgattcatacattagagacaaaaaattggttttcattttttaaaaatttcgaagaaataattatatttttagatcatcgtcaagtcggacactttttaaataaacataagttgccatattttcttatagaagatggttataactttttcaaagataagagagtttgccatttggagtctatacaatcttcttggaagagaatattatatcgttggtattttcgacctgcaacattaattggttcaagcccttattgtcaatctatagaggtaaacgatttatcgcttgttcatcctgaacaagcttacaaacccttcgtagaagttccgcgtaagaagttattcgatagtatatcgcaggaacgtttggaagcgatagtgcagatatttggagtaaagagtctctttaataatgaagttatcaaagaaaggagagtacttcttttaacacaacccttatcttgggaattttatgtgacagatgaagaacgcttagaaatatatttagctgggctgagaccatattataaggattataagatttatatcaagccacatccaagagatagctttgattattcctcattaggagatggtataattatttttcctcaggatattccaattgagttgtttgaattagctggatatatgaattttgatgtaggaatcacctatagttcctcctcaatggattatttagattgctttgatgaaaaggtttatcttcacgaaaaatttccgctgccttctaaaacaaaaatagattaataaacgttgaataggagcattcatgtctaaaaaatcaatagttgtctctggtttagtgtatacgattggaacaatattaattcaggggttgacttttattaccttacctatctatactcgagtcatttctcaagaagtatatgggcaatttagtttgtataattcttggataggaatcgttagcctctttattggtttgcagctaggaggaactttaggtccaggatgggttcgttatcgagagaaatttgatgattttgtatctacgatagttgtatcttcagttgtctttttcttacctatttgggggctttcctttctactaagtaacccgctatcaaccctgtttggtttgccttcatggattgtaccgctcctctttttacaaagttttatgaatgtcttacaaggtcttttgacaacctatttagttcagatccagcagtccatgctgactttactaatatcggtgcttagtgcagttgtaaacattagtttatccctatttctcattttttctatggaaaatgattttcttgcacgtattatggcaaattccacaacgacaggaatttttgcctgtatatctttaatatatttttataaaaaaatcggaattcattttcagaaagactatcttagatatggtttaactatctctatcccactaatatttcacggtcttgggcacaatgttctaaaccaatttgacaggattatgttagggaggatgttgacactttcagatgttgccctatatagttttggttatacattggcttctatattacaaattgtttttacgagtttgaacacagtttggtgtccatggtattttgaaaaaaagaggaatggagataaagatttactcaagtatgttcactattatctagcagttggactctttgcgactttgggatttttaacaatttatcctgaattagctattttactaggtggagaggaatatcagtcaagtattggctttattccaatgattattgtgggtatattttttgtgtttctatacagtttccctgctaatatccagttctatagtggcaatacaaaatttttacctattgggacacttatagctggattattaaatgtttcaatgaactttgttttaatacctacattgggaatttatggagctgctctaacaactacagcttcctatctattgctcttggccttacattatcgtgttgtaaaaagaaaatatgcttataatgaagtagcagtccctacttttatcaaaatagtaggacttgttgtggtatatactgggctaatgacagcttttgctgtttcaatctggattcgttggactctaggtttatttgttttattgatttatggttatatatatagaaaggaaatttctcttcttctacagaagaaaaaaggtaaataaatggtttatattattgcagaaatcggttgtaatcacaatggtgatgttactttagcacgtaagatggtagatgttgctgttgaatgtggagttgatgcagttaaattccagacatttaaggctgatttattgatttcaaaatatgcacctaaggcagagtatcaaaaaattacgactggggagtctgactcgcaactggagatgacgcgtcgccttgaactgagttttgaggagtatctggatttacgtgactattgtttagagaagggagttgatgttttttcaacaccgtttgatgaagagtcattagatttcctaatcagaacggatatgccagtttacaaaattccatctggcgagcttacaaaccttccttatctggaaaagattggccgtcaaggcaagaaagtaatcctgtcaacggggatggctgtaatggaggaaattcatcaagctgttaagatcttgaaggataacgggacatctgatatttctattttacactgtacaacggagtatccaacgccctaccaagctttgaatcttaatgttcttcacacgttgaagcaagaatttccaaatttgactatcggttattcagatcatagtgttggttcagaagtgccaatcgctgccgcagccatgggagcggaattgattgaaaaacattttacactagataatgagatggaagggccagaccataaagcaagtgcaactccagacatattagcagccttagtaaaaggaatccgcattgttgaacaatctttaggcaagtttgaaaaagagcctgaagaagtcgaagtgagaaacaaaatcgtggctagaaaatccattgttgccaaaaaggctattgataaaggtgaagtctttacagaagaaaacatcactgtaaaacgaccaggaaatgggatttcaccaatggaatggtataatgtcttggggcaggtgagtgaacaagattttgaggaagatcaaaatatcagtcacagtgcctttaaaaatcaaatgtaagtggagacaagatgaagaaaatttgttttgtgacaggttctcgtgcagaatatggtattatgcgtcgcttattaggtttgttgcaggaagattcagaaattgagttgagccttgtagttactgccatgcatcttgaagaaaagtatggtatgacagtcggagatattgaagcggataaacgtagaattgtaaagcgtattccattgaacctagctgacacgtccaagaaaattattgctagatccttggcaaccttgacagagaaattgacggatttgtttgaagaagtgcactatgacttggtaatgattttaggagatcgttatgaaatgcttccagttgccaatgtcgcactcctgtacaatataccaatttgtcatattcacggtggagaaaagaccttggggaattttgatgagtctattcgccatgctattaccaagatgagccatttacatttgacatctaccgaggagttcagaaaccgtgtcatacagttaggggaaaatcctgaatatgtgtataacattggggctatgggtgttgaaaatgtcttgaaacaagagtttctaacaagggacgaactcgctgaagaattaggagtacaattagcggaagaatactacgtagtactctttcatcctgttaccttggagaatgatgtagcagaagagcagacacttgccctactcacagccttagccgaagatgggaagcagtgtttgattattggttcaaattcagacacacatgcggataggattatgaaacgaatgtacgaatttgttactgaacatccaacgtctcatattttttcttcccttccaactcgttattatcattctttggtcaaatactcaaatgggttgattggtaattcctcatctggcttgattgaagttccctcattgcaggttccaactttgaacattggaaatcgtcaattgggtcgtctatcaggtccaagtgtggtgcatgtcgggaccagtaaagaagaggttggtatgggattaaagcagataaaagcagtaaccgattttacaaatccgtttgagcaaccagactcagcacagcaagcctatcaagcaatcaaagcattcttagcgatagaatcatccaccatgaaagaatttcatgatagataagtgaggtcgattgatgaaaaaagttgcgtttttgggagcagggaccttttcagacggggttcttccttggctagatagcagactctatgagctagttggttattttgatgacaaaccgatagaatgctatcgaggctatccagtatttggacgattgcacgatgttatagattatttagacactggcaagattgatgcggtctttgtgacgattggtgataatgtcaaacgtaaggaaattttcgaactgattgccaaggaacactataatgccctatttaacatcattagtgagcaagcacatattttttctccagatagtattaaggggagaggaattttcttaggtttttcaagctttgttggagcggattcctatgtgtatgacaattgtatcatcaatactggagcaattatcgaacaccatacaacggttgaagcacactgtaatattaccccaggagtgacagtgaatggcttgtgtcatatagggacagggacttatataggaagtgggtcaacggttattcaatgcattgagattgcaccgtatacaacattgggtgctggaacagtggtattaaaatcgttaacagagtcaggaacctatgttggtattcctgctagaaagataaagtaaggtgggttgatggaaccgatatgtttaataccggctcgttccggttcaaaaggattgccaaataaaaatatgttatttttagatggtgtaccaatgatttttcatacgattcgggctgcgattgaatctggctgttttaaaaaggaaaatatatacgttagtacagattcgcaaatttataaggagatttgtgaaacgacaggggttcaggtgttgatgcgaccggctgagttagcaacagattatacaacatctttccagttgaatgaacattttttacaagatttttcagatgaacaggtttttgtactcttgcaagtaacctcaccattaagaactggcaagcatgtaagagaagcgatagaattatatgatttaggtcaagcagatcatgttgttagttttacaaaagttgacaagtcaccaactttatttacaagcttggatgaatttggttttgctaaagatattgcaggactaggtggcagttaccgtcgccaaaatgaaaagacgctctattatccgaacggcgcaatttatatttcttctaaagcagtttacctgcatgatcaaacttatttttctgaaaagacagtagcttatatcatgaataaggaagattcaattgatgtggatgatcgctttgattttactggtgttattggtcgaatgtattttgactatcaacgtagagagcagcaaaataaaacattttatcaaaaggagttaaagcgtctatgtagtcagctaacaaatgataaacttatcataggagatagtcgcctgctatcattgacacttgatggttttgataatatcagcattggcggaatgactgcagcgacagcattggaaaatcagcatctttttctaaaaaagccaatgaaacaagttgtgctttccttaggtgttaatgatttgatcacgtcctatccgatttatgtaattcaggagaatatccgacagctgatggagttgcttgtgagcagggttgataaggtttttgtgacaacaattgcctacacactttttcgtgaaagtgtttcaaatgatgatattatccaattgaatcagtatgttcgtaaattggcaactgaacatggcatctctatcattgatattaatgaagtagttgccaaggatgacctacttgactatcagtatacgaacgacggtctacatctcaataagcgtggacaagggcgtgtgaaccaactaatttgtcaagccgtggtcgaagaaaactagatagaatcattgaacatataaaataatgttaatgctatgagaaatctagagatccaattttctctcctatgaattttgaacttatattcgcataggttaatttgactctgtttggcataatatcctgtgtgtgataccaattgagtagagatgttggataggaaagttaaatgtaaaaacaatatgaaaaatacgattatctagttgttggtgcaggtctgttcggagtggtctttgctcatgaggcagctaaaaagggtaaaaaaataaaggttatcgaaaaacgagaccacattgcaggtaacatctataccaaagaagtagaaggtattcaagtccatgaatatggcgcgcatattttccatacttctgaaaaagaaatttgggattatgtgaatcagtttgcggagttcaaccgatataatgttgatttctttgccaataaggaagactatttagctacctatccgaagattgtctttacaggaatgattgatgaattctttgattaccaacttggtgaattagaatatcgtagccttcgatttgagacagaagtgttggatatggaaaactatcaagggaatgcggtagtcaactatacagatagcgagacaccatatactcgaatcatcgaacacaaacatttcgaatttggtacacaagaaaaaaccattattacccgtgagtattcgaagacctggaaacgtggtgatgagccgtactatccagtaaataatgacagcaacaacaaactctatacggcctacaagcgccttgcagagcagcaagaaaatgttatttttggtggacgtctgagtcattatagatattacgatatgcaccaagttatcggtgcggccttgcaatgtgtgtgaaatgaagttgggggaatgattttgagaagtcatcaaagtagtaattgattcttggcagaagttggaatgctctcaaaatgttaatcaaaaaaaaccggctctttgtcaactgtagtgggtagacgaaaagataacacctagagaggacgaaattcgttctctcatttttgatgtttaaagcaatatatatctttgttttaaagttcgtaaagttcctaaagccgaacgcttgcctcttgatgtctttgatgagtttattggttgcttccagcttagcgttggaataaggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaacttcaatgtcttctggacaacctctctcggtgttactgtttgcccaaaagtgcgagaaaagaagcgattcagagacagttttcgactatctttttggagaatacgccagtgatttttcatggatcgataaggtagggaacgcgtatcgaaagtcttcataatatcaattctagtcgtcatcatagcacggctcaggtgttggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtggtttggcggttgttgtcaagaatggtcacaatcgatctcgtctcaaaattctgagcaataaaggcgagttttcccttgttccgactaaattcatcccagctcaagacctttggtaatttcgtaaaattatgctcaaattgaaactgagccagtttcctctggacgaccgatacggagatatgtaatctcctcgcgatggctatattggtcatgttttctgtatgtagttgtgtcactttctcccaaataggtagggaaatctgacagtttttcttgactagaggtgtctcagctacagttactttttggcaagatttgcattgaaaccgccgtttcttaagcaagaggagggtcggaaagccctgacaatccaaaatcggaatctttgacgacttttgaaagtcgtacttgatacattttccttggcaatgaggacaacgaggactgtcgtaatctagctttgccctgatttctagatgggtctgatgtttcaaaatgaagagaattttgatgtttttgtctttgattccaattagttctgtggtatgataaagttgttccatatgagtctttctaatgtgagtgtggttgcttttcattataggtcatatgggactttttgtatatactcaaaaaggctccataatctctacagtggatttacccactacagaaattatagagccgaaactgttttgtcagctaaaccaaggttactattagccttggctacttagtctaacagcttcaaacctgttatcaaatgaaattaccggcttactcaaagatagtgaaacaagtattttggggtaaggcgaggtggctaacttcattatagaactttcaaaatgtaatggaaattgatttttcacaagtaattgtcataaaaatcagaaaatattttataaatatgataaaatgaaaatgatactagtttgaggtaaggatatgaaattaagaagaaacgtagaaaaactaaagggaacgattcgtgtcccaggtgataaatcaatcagtcatcgttctattatttttggttcccttgcaaaaggtgttactcgtgtccacgatattttgcgtggggaagatgtcttgtcaaccatgcaggtctttcgtgatttgggtgtaaaaattgaagacaatggtgatattgttgaagtacacggtgttggctttgatggtcttcaagcacccaaaaatgatttggatatgggaaattctggaacctcgattcgtttgatttcaggcgttttagcaggtcaagattttgaggcgactatgtttggtgatgattccttgtccaaacgtcccatggaccgagtgactattccactcagtcaaatgggagtagagatttctggacaaactgaacgtgacctacctccgttgaccatcaaagggaataagaatttaaaaccaattcgctaccaactccctgtagcctctgcccaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgccttttggttggttgctggcttaatcgtaccaggttcaaaaattgtccttgaaaatgtgggaatcaatgaaactcggactggtattctagatgtcattaaagctatgggcggaaaaatgaccctttctaacatagatgaacttgcaaaatctgctaccattacagttgaaacgtcggaattgaaggctacggagattgcaggcgaattgattcctcgtttgattgatgagttgccaattattaccttactagcgactcaagcacatggaacaacgattattcgtgatgccgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaagaattgctggatttacctagtaattgtatcgtgtcaactggtggtggggtgattaaatctgaagtaaacagggaattgctgttggcaaatagggaggacaatgtacttcttactgcctcctttgatgtttcctatcagagaattagtaaggatagacagtcgcaaagacctctctttttacagtacagtaaggaagagtttgaagccctctatcgtgaacgaatggcactttatcaaggtttagctaatactgtaatcgatacagataaactgaatccagaacaagtagcaaggaaaattttatgcaagtagcctatctaggacctcgtggttcttttacacatcaagtggcccagcaggcctttccgactgcggatttgcaggcttttgaaacgattacagaggttatcaaggcctacgaaacgggggaagttacctattccgttattccagtagagaactcgattgaaggtagtgttcatgaaacgattgactatctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagccagtacagcctatgctgctcgctttgtggcagaacaccctgaacaaccattcgcggcaattgctccgcaagcggcagctgttgaatatggactggaagtaattgcgcaagacatccaggaaatcagcgagaattttacacgcttttggattttgggggataaggctccgtctattgccctggaacaagtagctaaaaaagtcagtcttgcacttacattgccagataacctgccaggagccttgtataaggccatgtctgttttctcatggagaggaatcagcttaacaaaaatagaaagccgacccctgaaaacggctttgggtgagtattttttcatactggatctggacaatcagtctgaggaattatta

SEQ ID NO: 40 - DNA, 26574 bp, Streptococcus suis
attacaggtgggctatctggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagtgagagagctttttgcatgataagattggtatcgtagtcgattagactcttatgtttgatgaaggtatcacgtagctggttaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagatagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagccggtgctggatgccataagtcaatttgatgtaaaaaagatggctgctttttataaattgaatgaagaaaaggctgagttagaagctgaccgttggtatcgaatcaggacaggtcaagcaaaaacttatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgcttagattttcaagggagcttaaagatagacaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagttatgaacaagattgaacaagataacgtttttcatcactaaatatggctatgtggctagtaaaatattgttttttgtgatacaataggtgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcacttgtcatcacttctgtcggaatctatggaatgcaagaagttgtaaaattttcaacacgactaaattcaaattcggcattttcagaatatgaaatgagcatcctcgtcccagtaaatagtgagattacagatgttcgacaggtcactaatgtacttgctccggctgaatacgatcaagacaacatcactgctttattaaatgatatttccaaaatggagtctactcaactagcaactagccccgcgacctcttacctgacagcatatcaatctatgttgaatggcgagagtcaagcgatggtgttcaacggagtttttaccaatattttagaaaatgaagatccaggcttttcttcaaaagtgaaaaaaatatatagtttcaaagtgactcagactgttgaaacagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacattgctattgcagatggtgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgaggtcaccagataatctagcgaattatcaagctattctaactggtttggaaggaactatccaaacagatttgagcttagaaacgattatgggcttggtaaatacccaattagaatcaggaacacaatttacagtagagtcacaagcagtgacaggaacaggacgctcagatttatcttcttatgcgatacctggttcacaactttatatgatggaaattaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaaatcttcattctagtaactgcggtattaggagcagggctggcatttgtttatagcagttttttggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggtgcaaaagattgttgaggtcactaaggtaagcgatgtgacaacacttgaagaagcagtcccagcggaggaaccaaccactccaaatataaaacgaaatatcatacttggcttattagctggtggtatcttggcaacaggtcttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtaagaaaaaagaattggtaaataagactgaagaatatttcaatgccatccgtaccaatattcagcttagcggagcggatattaaggttgtaggcattacctctgttcaatcgaatgaaggtaagagtacaactgcgactagtctcgctcttgcctatgctcgttcaggttataagaccgttttggtggatgcagatatccgaaattcagtcgtgtctggtttcttcaagccaatgacaaagattacaggcttgacggattacctagcagggacaacagacttgtctcagggattatgcgatactgatattccaaacttgaccgccattgagtcaggaaaggtttcacctaaccctactgcccttttacaaagtaagaattttgaaaatttacttgcgactcttcgtcgctattatgattgtgttatcgttgactgtccaccattaggactggtaattgatgcagctatcattgcacagaaatgtgatgcgatggtgctggtagcagaagcaggcaatgttaagcgctcatctttgaaaaaagtaaaagagcagttggatcaaacaggcacaccgttcttaggcgttatcttgaacaaatatgatattgccaccgagaagtatggtgaatacggaaactacggaaattacggcaaaaaagcttaatttctcagataatataagtttgataagtaggtattagtatgattgatattcattcgcatatcatatttggtgtagatgacggccccaaaactattgaagaaagtctgagtttgataggcgaagcttatcgtcaaggtgttcgctatatcgtggcgacatctcatagacgaaaagggatgtttgaaacaccagaaaaagtcatcatggctaactttcttcaacttaaggaagcagtagcagaagtttatcctgaaatacgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgatgctacttgggctaactcccgtacttgctcatatagaacgatatgataccctagcgtttcatgcagagagagtagaagagttaattgacaagggatgctatactcaggtaaatagtaaccatgtgctgaagcccgctttaattggtgatcgagcaaaagaatttaaaaaacgtactcggtactttttagagcaggatttagtacattgtgttgctagtgatatgcataatttatctagtagacctccgtttatgagggaggcttataagttaataacagaggaatttggcaaagataaagcgaaagcgttgctgaaaaagaatcctcttatgctattaaaaaaccaggcgatttaaactggttactctagattgtggagagaaaaatggatttagaaactgttatcgataaacttttagagcgcaacattaaacgattgatactcatgtgcatggatacgtgtcttattatagtttccatgattttgagcaggctgttttttgatgttattattgacattccagatgaacgctttatttttgcagttttatttgttttaatattctacctgattatctcagttagactaaaggttttttcgctaattacgaggtatactggatatcaaagttatgtgaaaataggactgagtttgatatccgcttattcattatttttaatcatttcaatgattctatggcagacctttagttatcgtttcatcttagtatccttatttttgtcgtatgtaatgctcattactccgaggattgtttggaaagtcttacatgagacgagaaaaaatgccattcgaaagaaggataacccactaagaatcttagtagtaggtgctggagatggtgggaatatttttatcaataccgtcgaagatagaaaattgaattttgaaattgtcggtatagttgatcgtgatccaaataaacttggaacatttatccgtaccgctaaagttttaggaaaccgtaatgatattccacgattggtagagaaattagctgttgaccaagtggtgattgccatcccttctttaaatggtaaggagcgagagaagattgttgaaatctgtaacactacaggagtgaccgtcaataatatgccgagcattgaagacattatggcgggtaacatgtctgtcagtgcctttcaggaaattgacgtagcagaccttcttggtcgactagaggttgttttggatcaggatgaattgaatcagtttttcaaagggaaaactatccttgtcacaggagcaggtggctcaatcggttcagagttatgtcgtcaaattgctaagtttacgcctaaatgcttgttgttgcttggtcatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttccattgatggaatataatccacatgaagcagtgaagaataatatttttggaacgaagaatgtggctgaggcggctaaaactgcaaaggttgccaaatttgttatggtttcaacagataaagctgttaatccgccaaatgtcatgggagcgactaaacgtgttgcagaaatgattgtaacaggtttaaacgagccaggtcagactcaatttgcggcagtccgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatctttgtcttggatatgggtgagccagtacaaatcctggaattggcaagaaaagttatcttgttaagcggacatacagaggaagaaatcgggattgtagaatctggaatcagaccaggcgagaaactctacgaggaattgttatcaacagaagaacgtgtcagcgaacagattcatgaaaaaatatttgtgggtcgcgttacaaataagcagtcggacattgtcaattcatttatcaatggattactccaaaaagatagaaatgaattaaaagatatgttgattgaatttgcaaaacaagaataagaaagtaaaaaatatttttactttcctagagtttaaacgatgtttaagttctaggaaggttggaattgctttcgtggaggtgatagatagaaacctatatatttgtagaagaaaggatattaaactaaaggtgaatcggaacataaagtttagatagagttggtatttaatgccaaacaggtgaatgcaacctctcgctcgttactaagcaggagatagtaaagttgcttgaaagagagtttgttaatcagtataagtaggctaaagtgagaatatatatctattattatcggtaatgatactattattgagaattattgtagtggggataaaaataatttttggtgattttatcgtccgacttaaaggtgggttaaaaaagtacttatattcttttagaattgatgaaaaatatgggggaatataatatttataggagatacgatgactagagtagagttgattactagagaattttttaagaagaatgaagcaaccagtaaatattttcagaagatagaatcaagaagaggtgaattatttattaaattctttatggataagttacttgcgcttatcctattattgctattatccccagtaatcattatattagctatttggataaaattagatagtaaggggccaattttttatcgccaagaacgtgttacgagatatggtcgaatttttagaatatttaagtttagaacaatgatttctgatgcggataaagtcggaagtcttgtcacagtcggtcaagataatcgtattacgaaagtcggtcacattatcagaaaatatcggctggacgaagtgccccaactttttaatgttttaatgggggatatgagctttgtaggtgtaagaccagaagtacaaaaatatgtaaatcagtatactgatgaaatgtttgcgacgttacttttacctgcaggaattacttcaccagcgagtattgcatataaggatgaagatattgttttagaagaatattgttctcaaggctatagtcctgatgaagcatatgttcaaaaagtattaccagaaaaaatgaagtacaatttggaatatatcagaaactttggaattatttctgattttaaagtaatgattgatacagtaattaaagtaataaaataggagattaaaatgacaaaaagacaaaatattccattttcaccaccagatattacccaagctgaaattgatgaagttattgacacactaaaatctggttggattacaacaggaccaaagacaaaagagctagaacgtcggctatcagtatttacaggaaccaataaaactgtgtgtttaaattctgctactgcaggattggaactagtcttacgaattcttggtgttggacccggagatgaagttattgttcctgctatgacctatactgcctcatgtagtgtcattactcatgtaggagcaactcctgtgatggttgatattcaaaaaaacagctttgagatggaatatgatgctttggaaaaagcgattactccgaaaacaaaagttatcattcctgttgatctagctggtattccttgtgattatgataagatttataccatcgtagaaaacaaacgctctttgtatgttgcttctgataataaatggcagaaactttttgggcgagttattatcctatctgatagtgcacactcactaggtgctagttataagggaaaaccagcgggttccctagcagattttacctcattttctttccatgcagttaagaattttacaactgctgaaggaggtagtgtgacatggagatcacatcctgatttggatgacgaagagatgtataaagagtttcagatttactctcttcatggtcagacaaaggatgcattagctaagacacaattagggtcatgggaatatgacattgttattcctggttacaagtgtaatatgacagatattatggcaggtatcggtcttgtgcaattagaacgttacccatctttgttgaatcgtcgcagagaaatcattgagaaatacaatgctggctttgaggggacttcgattaagccgttggtacacctgacggaagataaacaatcgtctatgcacttgtatatcacgcatctacaaggctatactttagaacaacgaaatgaagtcattcaaaaaatggctgaagcaggtattgcgtgcaatgttcactacaaaccattacctcttctcacagcctacaagaatcttggttttgaaatgaaagattttccgaatgcctatcagtattttgaaaatgaagttacactgcctcttcataccaacttgagtgatgaagatgtggagtatgtgatagaaatgtttttaaaaattgttagtagagattagttattttggaaggagatatggtggaaagagatatggtggaaagagacacgttggtatctataataatgccctcgtggaatacagctaagtatatatctgaatcaatccagtcagtgttggaccaaacacaccaaaattgggaacttataatcgttgatgattgttctaatgacgaaactgaaaaagttgtttcgcatttcaaagattcaagaataaagttttttaaaaattcgaataatttaggggcagctctaacacgaaataaggcactaagaaaagctagaggtaggtggattgcgttcttggattcagatgatttatggcacccgagtaagctagaaaaacagcttgaatttatgaaaaataatggatattcatttacttatcacaattttgaaaagattgatgaatctagtcagtctttacgtgtcctggtgtcaggaccagcaattgtgactagaaaaatgatgtacaattacggctatccagggtgtttgactctcatgtatgatgcagacaaaatgggtttaattcagataaaagatataaagaaaaataacgattatgcgatattacttcaattgtgtaagaagtatgactgttatcttttaaatgaaagtttagcttcgtatcgaattagaaaaaaatcgatttcacacgataaaatatcaaaaaaactacgtagtcactatgatttatttcatatttgtgatgaacagcctcctttaaaatccttatggtttgcagtttttaatatgtattatgggattttgaaaaaaattagatatgaaaagcaattttagttaatggaatttaaaaagtagggatggggaaatgaaaaaatcagatttaacagtgattggacactttggaggtacagagacttttaacgatggccaaactgttaagaccaaaaatttggtaaaagaattacggttggcaggactaaaaaatataaaaattgctgatacctactataagaaaaagaaccctttaaaactattagttcagacgatttatgctctttttttctctaaaaatatcattattttgctctcaacaaatggcttaagattctttttgcctctcctttattatggaaaaaaagtttctaaagttagaatatttcatgatgttattggaggtagactgggagaatatattgataaaaatcctagttttaaaaagtatttaaattcttttgatctcaacattgtggaaactgtattattgaaagatgaactaattcaaagaggtattgtgaatgttgagataattcccaattttcgtcgaatggacccgatagatatttctaaggtaaaggcagatgattattctattcctttcaaattctgtacattttcgagagttattaaagaaaaaggaattggtgatgctatagaggcaatcgaggcaatcaatacaaaaaataagagcaatctctgtcaattggatatatatggacctattgctaaagagtatcaagtagaatttcagcagttacttgaagaatcatcagagatgattaattatgtcggtgaagtttctccagatgaggcggtggaagttttaaagaattactatggtgtcctttttcctacctattggccgagtgaaggtagtgctgggacaatatcggaaagtttttttgctggagtacctgttatagcaactgattggcgttgtaatgctgaaatgataaaagatggtattgatgggatcatatatccaggaaactatgctcagaatttagtcgatggaatagattggcttatttctaagaatgcagatattattgatataaagcgttcttgtatagaagcatcggattattatcaacctgacaaacacatagctagactagtgaagttactaaatgtaaaataaggagttcctttattgatgaatattgaattttttggccctcctggtacaggaaaaacctatattactgaaaaattgacaggaattagtaggcaagaacaaaaagataattcgcataaaaaaagtattcgactgctaaaaaaattttcaaaatattcccccccctctctcttttataggtataaaataaagaaagtattgagcggtaaggtgttgcattaccactatcatgatacttctttagaagagatgattgatagtatagtattggtagcaacgtcatatagattgaatttacgaccagacggtattttagatgaaggtttagtacaacgtgttgtctcaatgggaattaatttccaattatcaaagaatatcattttgggtttgatagagttgttttcattaccattatctgatgtaaaagtagtttttatatctatggacaaatcaaagattttacgttcaattcaagaaagaggacgaaaagaatcgaaaatggattattttgaagatgataagttgacaaatttcgttgaacaatacatagaggtttgccaatttattgcagaaagttttcattttgaaacaattacaagaagtgatttttctaaatttattgaggagaataagagaaaatgatagcatttgtgatattacattatcaggcgatggaagagacaatttcatgtgttgaaactataaaaaacatggtcaaagaagaaaagaagatagttattgttgataatgcatcgccaaataaaacaggcattaatttgagagaaaaatatagtcaagatagtgaagttatagttctgttatccgaaaaaaatcttggttttgcccaagggaacaacattggttataaggaagcgcgtaaattttcaccagagtttattgtcgtgatgaataacgatgtgtttttaacacaagaaaatttttattctcttttacaagaatcacataaacgttataattttgatgttttgggaccagatatttattctactaagactaatttgcatcaaaatcctcaacgtctatctaactattccctttcagaattaaagactacgagaagaaaattaacttttaagaataaatttaaaatattaattagaataaaatatttgctacgtagaactgcagatgaaactgcttcgcaagttgaaggttttgacaaggtacaatttggcaagccattgcatggtgctgcatatatcttttctagaaattttacacaaaagaacgaaaattgcttctatccaaagacttttatgtactatgaatcatatattcttcactatctcggaaccaaaaatggattttcttttgtctacgacccaagtataaaagtcacacatcatgaagatgttgcgacaaatcagacctatgatgatttgtataaaaaagtagtttttgttaataaatgtttattagattcttgtaactcatttatagaattaatggaaaacgaagagcaaattgggagtatttagtgagttttttatatattttacttctaggtttatgcctactatttattctgacttatatcttttctaatagggatattttatcaccttctgtcgtcatgactttagtttttattgttagtacagtttttgcgatattaaatattagaaattgggaaatcgactataatgttagtgctggattaattacgttgagcggaatttttgtattttttgtttcagagatgatgggaaatattttttggggtaaacgcgtaaagcgaactacctacctgaactttgattttcaagaaattacaattgataaatggaaattatactttctaattatttttaacttcttcatagtcatttggtatttcctaaaaattcgttccattgtaggtggaggaagtattggagagatatttcaagaatatcgtcgtatcggtgtgaatcaactagaagggaaagacgttgaaactgtaggtggaataattaaccaatttttaaaaattgtagagggtactggatacgttgcaggcttcacattgataaataattatatttataagtctaagaaatggcagcaaaatgtaatgttggttattttgataggattatctattttaccagggttgtttggagctggtaggactcaagtcttaaagcttttaagctcttttgcgataatgtcttacgtaatttggcaacaaaaatatggttggaataaagtgatgtcatggaaagtattaggaaaagggacattagcagcatttatagggattccggcattttactattcgcttgctttactggggcggagtacgactcgatcacttttagactactcatcaaattatttatctagtggtatgattttattttcaaagtatattgaagagcctgttactcgtattatgtggggagaggaatctttaccgaatattttaaaagttcttcatgctttaaatttatcaccagcttcaacttcatataatctggaatttagaaggttaggtatcggatacagtaatatttattcattttttaggcgtccgtaccatgattttggcttacttggaatgtatattttcgttgcattaatagctctgtggttttcttttctttatttcggaaagattaagtatatgtcacaaagtagtgttacatcaagatggttgttagtgtatagttatttctactattggataatatcttcttctataattcaatatagtgttgcttatgtttctattggaactatattaaatttattagtaatattgcttttatatcaatttttaataggtaatagtaagaaaattaggcttcgtttgaaatagatgaggaattataatttatgaaaaatcgttcgttaaagataaacgccttgttaaatgtcgtccgacaaggaatgacaattctttttcctttttttacatttccgtatatttctagaattcttggatcgacggaatttggaaaatataatttttcaaattctattgtgagttattttgctctattagcagcatttggaatggcaaattttgctgtacgagaaggagcgaggattagagaggatcgtcagaaattttcagcttttgcttcagagttgtttacatttaatatcataacaacagttgtttcgattgttcttttgatcatagctacactatcaagttccaaattatcttcttatacagtacttatttttatacaaagcgtgagtattttattgacaacaattggtctggattgggtgaatacggtatatgaggattatctatatataacaatacgttacattgttctacaaattatagctttgatattgatttttttacttgtaaaatcttcgtcagatacagttatatattgtttaatattgcttttgggttcttatggtggaaatttggtcaatttagtttatatccgaagatatgtggatattaaactcaattggaaaatacaatataaaaaaattttatttccactgaccattctttttatcaattctcttgcggtaacagtttatgtaaactcggatataactattttaggactatttacatcagaccataatgttggaatttatagcttttctactaaagtttacaatatattaaaacatttgattaatgctgcaattgtagtgacgattcctcgtttgacggctatttatgggagaaacaaagaagattataagaaccagctcagtgaaatttttaatattctaattatttttttgataccaatatctgttggtatggttatgatgagtgactctattattttacttattggtggtgaggaatatttaacaggagaaagttcgcttagattattgagcatttctctaatttttgctctactttcttctgtttacgtgaatggaatgctaatcataagtcgtcaagaaaagctaacattgttaggaactattttatctgctgttatcaatgtggttggaaatttcttattaatacccaaaataggtatggttgcagcagcgattacaacagtacttgctgagggaattaattttattatacaacgctatttttcaaagaaatatgtcttgaatacgtatttttttgaaaaaacttcaatcatttgtgccatattaggaggtataaccacatttttagtttgttactatgtaaatggtatatttcttgggacaaccattacgattgttgtaattcgaatcatgcttgcaattttattatccagttttgtttatttaatcatattgatactattaaagtatgagagattgatgcgttatattaaataatctaaaatgatactggtaaaggaacttattagtaaaatacaatatggaggttttaagatgcaaaaaaatatcgccgtcgcaggaactggctatgtcggtctatctatcgctgttttattggcgcagcatcatcaggttacagctgtggatattatccaagaaaaagttgacttaatcaattctaagaagtctccgattcaggatgattatattgaaaaatatctagctgaaaaagacttaaatctagttgcaacgttggatgcagaaaaagcctacaaagatgcagaaattgttgtaatcgctgctccaactaactatgatagtgctaagaactactttgatacaagtcatgtcgaagcagttatacaaatggtattatcggtcaaccctcaagctttaatggttatcaaatcaacgattcctgttggttttacccaatctatgcgtgaaaaatttggtacggaaaatattatttttagcccagaatttttacgggaatccaaagcactttatgacaatctttatccctcgcgtatcattgtatcttatgagaataattcaccacaaacagttattgagggggcgaagctttttgcaaaacttttacaacaaggtgctctaaaagaaaatgtcgaagtattacacatgggtgctacagaagcagaagcagtcaagctgtttgctaatacttatttagctttgcgtgtttcttacttcaatgaattggatacttatgcggagctaaaaggattagatacagaatcgattattcgaggagttggtttggatcctcgtatcggtgatcattataataatccctctttcggatatgggggttattgcttgccaaaagatacaaagcagttattggctaattacaatgatattccgcagaacatgatgacagctattgtagagtcaaataggactcgtaaggattttattgctgatcaaattttgaagatagctggttattatgattattcgtcacatgatcaatattctcaatcgggagaaaaagaagtgaacatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttggctctttgtcaactgtagtgggtagataaaaagctaacacctagagaggacgaaattcgttctctcatttttgatgtttaaagcaatatatatcttggttttaaagttcctaaagccgaacgcttgcctcttgatgtctttgatgagtttattggtcgcttccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgctagtgatttttcatggatcgataaggtagggaacgcgtatcgaaagtcttcataatatcaattctagtcgtcatcatagcacggctcatgtgttggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtggtttggcggttgttgtcaagaatggtcacaatcgatctcgtctcaaaattctgagcaatacaggcgagttttcccttgttccgactaaattcatcccagctcaagacttttggtaatttcgtaaaatcatgctccaattgaaactgagccagtttcctctggacgaccgatacggagatatgtaatctcctagcgatggctatattggtcatgttttttgtatggagttgtgtcactttctcccaaataggttgggaaatctgacagtttttcttgactagagctgtctcagttacagtcactttttggcaagatttgcattgaaaccggcgttttttaagcaagaggagggtcggaaagccctggcaatccaaaatcggaatctttgacgacttttgaaagtcgtacttgatacactttccttggcaatgaggacaacgagggctgtcgtaatctagctttgccctgatttctagatgggtctgatgtttcaaaatgaagagaattttgatgtttttgtctttgattccaattagttctgtggtatgatcttcgcttttttatttctaggctcaggaatccagagtcacttccctgactctggatttattccatatgagtctttctaatgtgagtgtggttgcttttcattataggttatatgggactttttgtatatattcaaaaaggctccataatctctacagtggatttacccactacagaaattatagagcctaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaccaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcctcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttccttcccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacactttgttctttaagataatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgagcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagaaatcagtgtataaaattaataaatttgaaggtgaaatctatcagaagttaaataaaattcttgattcatataaccaagaacagaatagcctgataaaccttgctgcatgtattagctatccattcaccgaagtattaaagattcaaagtttccctctcgctactctgccaacagagggagctgttgaaaaacgcttttttcctcattgtacttcattggataatattgaagtatattcagaagaattgtgtcttcaactttttgatttaaatcctggtgattatagagttaatgtgcaaccacattcaggaactcaagctaaccaaatagtctacaattgtgttttagaaagagacgattatattttatcgttatctccaaaagacggaggacatatttcgcatacttatacaggtaaaggtactgtaaaatattatcacttagaccataacttaaatattgattatatcgaattaaaggaattattagataaatataaacctaaattgattattattggtgcttcgtcgtatggaaatgaatttaattatcaacaaatttatgaaattataaaagaggttagcccaaataccctcatcttagcggatatttgccacagtgttttatatattatggcaaagctacataagtcgatttttccatatgtggatttcgctacttttacaatggataaatgtttacgtgggcctcaaggaggagtactactgtatcgttctatatttgaagaaaaaataactaattcaatttttcctagaacacagggtgggcctacacaaactgcattatttgcgaaatgtatctgtttaatcaaattattatcaatagatattcaagattatgctaaacagattataaaaaatacttaattgtttataaaacaattaagtaaagagggggttgatgttgtttataaaaaaccaaagactcatataattttagttaatctattgaatctaaacttgagtggtaaggaggcagagaatctactttttcagcataaaatattagttaaccgaaatcaaattccaaatgatacacacggaccaatgacgacttcaggaatgagattaggaacagttggaattacaaatttatcctatactgatgaagatataaaaaaattagctaaactagtagctaatttattaaagtataaacaatatgattattccatatatttagatctcattcacaagtaccatgaacaaattaatatctccaattaggagaaagacctatacagaaattatattttttgtatggaatcaacagatagtatttggtgagcccgtcttgataatcatcaatataagttttttcataaacaaaaggaatatcttcaaattgttgtaaattgtatactatttgaaatttataccaaggatcgtctatgagtggaatttctgcctcaaagctctttagtgaattttgaaattctgtaaaagagattttttcagaaatcaactcaataattaatttgtttaacttgagcatcctaatatctaaggtcaaagctttaggacattcttgaagtgatttatttataaattccagagattgttgataatttttattcatcagaaaaataattgatttattacaatatggttcaaaaatttcatttgaatcatatttttttagtattttttcggccttatttatattctctaaagctatatcatattgcccatcccatatattaacaacacctagattattatatactgttgcaacaggtatttgatattcattacgttgaaaatagtccaatgctaattcgagatttttggtagcttctttggttgggaaataatgagcagaatttcgtaaaataatataatagaagtcgtctttttctacagaattcatggtctcattaaggagtttaattgcatcttgatctttacctaaatgaccataagcatttaacttgtagagtaatgttccagagctattttctaacttttccagtgattttagtgcctcctcaaattcatatttttgaatttgaaatctaggataatatagttgtaaatcttttgaataattatcttgttgaaggctatttaaaatagctaagcctccattgaaatcagaaatccactggtacgagttcaatatataatgtaagtatttttatggtaataattctattaaatgatgtatcttcttgctcaaagatgcaatgtaaaaatatgaatttttcctgtattctatttcaagtaactgtttgatatattctacattttgtcgtaactctttaatattacatatatttattaagcagtgaattaaataagctaactcgccaccaactcctatagataagatagtttgctctaaatatatttttagattgttggttactaattgaagatcagaagcatttgtgtgatttaaaatactatttacaattgattcgtgtgaaattttgattttatcatttgtatctccattaatatatacgaaacctgcatcaataagggattttagagaatcagctacttcaatattttcatctactatagatttaatgtaattaaaaactatatcttttctcataccagcaggaaaaattgatgatatgagaagtatatttttttgaatatctggaagtttgtcatatatatcagaaatattaaataattctgaatttggattatcaataagtctgttaataatcaattcaatctctttatagttaccttgtgttatctgccagatttgattcaatttgatattatcaagtaaagcaattttatttcttattagtaatttacactcatcctcagtaagatacgataaatttaatacagtaggagtataattgtccaatgtatctagtttatcaattgattttaacttatcagttgttcggtttataatagttaaggagactccgctttgaagtgtattaaagtcatcttcaaattttatttttatatcttcagataaaaattgataattatcaataataatattcagacggattttttttgaaacatgactgaaatatcttaaatataaatcactttcaaatattccctcctttatttcagtaacaacttcttcccaaggataatcaattacttttttataggttgtatcgaatgaaatcaaagatctgattaacctaaaactatgtttcagagttagatttgttagtttttgttttcttaaataatttgaaaatgaatatttttgaggtattgataagcatagatttcttctgaattgagttgggacatacgctccttttagtagattttcaaaaaatttattactttcaaacccgtcatttgtaacatcaatgtagagaataaacgcttctttatcatgactgtaaacttgttgacaaacctctttgattaactcggttttaccactaccacttaagccattaataatatataaactatttttatcattactggaaaatttaaaatgctgttttaattcttctatttcagtatcgcgaccgtaatacataaaacatctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaac

SEQ ID NO: 41 - DNA, 18592 bp, Streptococcus suis
attacaggtgggctatctggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggttatgaagtgaaagcgtgattcacagagtaacaattttgggatgtaatttccactatagaataatccccctcgtcttctaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgataggggatgttcaaagcgtatttctctaaacaatcttttattttattccactgagcgtgataaatgtgctgaagatgctgtgtgttccgtgcaaacataccgttatcaatgtagagcgagagagctttttgcatgataagattggtatcgtagtcaattagactcttatgtttgatgaaggtatcacgtagctgattaggaaggctgattgcaccgattcggagggcaggaaagagtgtcggtgtaaaagattttatgtagatgacacgattatctgtatcaagatagtgtaaaggtaggctatgactagagtcgaaatccgctaaatagtcatcctcaatgatgtagacatcgtattgctttgctaattttacgatggctgtttttgttgctatatcataagttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagatagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagccggtgctggatgccataagtcaatttgatgtaaaaaagatggctgctttttataaattgaatgaagaaaaggctgagttagaagctgaccgttggtatcgaatcaggacaggtcaagcaaaaacttatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgattagattttcaagggagcttaaagatagacaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagttatgaacaagattgaacaagataacgtttttcatcactaaatatggctatgtggctagtaaaatattgttttttgtgatacaataagtgagttataagtaaaaggaaggttgtttatgaagaagagaagcagatggagggaatcgcctaagcttaagttggtaaattttgcgctttgggtgctatatgccattattctatgtctgttcttagttactatgtatcgctataacatcctagattttcggtatttgaactatattgtaacaatcctgttgataggggttgcagtattgactggcttgttgatgtggcgtaagaaagcacgcatatttacagcactcgtacttattttttcacttgtcatcacttctgtcggaatctatggaatgcaagaagttgtaaaattttcaacacgactaaattcaaattcggcattttcagaatatgaaatgagcatcctcgtcccagtaaatagtgagattacagatgttcgacaggtcactaatgtacttgctccggctgaatacgatcaagacaacatcactgctttattaaatgatatttccaaaatggagtctactcaattaactacaagtccgacgacctcttatctaacagcctaccaagctatgctaaatggcgagagtcaagcgatggtcttcaacggagtttttaccaatattttagaaaatgaagatccagacttttctccaaaagtgaaaaaaatatatagtttcaaagtgactcagactgttgaaacagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacattgctattgcagatggcgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgaggtcaccagataatctagcgaattatcaagctattctaactggtttggaaggatctatccaaacagatttgagcttagaaacgattatgggcttggtaaatacccaattagaatcaggaacacaatttacagtagagtcacaagcagtgacaggaacaggacgctcagatttatcttcttatgcgatacctggttcacaactttatatgatggaaattaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaaatcttcattctagtaactgcggtattaggagcagggctggcatttgtttatagcagttttttggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggcgcaaaagattgttgaggtcactaaggtaagcgatgtgacaacacttgaagaagcagtcccagcggaggaaccaaccactccaaatacaaaacgaaatatcatacttggcttattagctggtggtatcttggcaacaggtcttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtaagaaaaaagaattggtaaataagactgaagaatatttcaatgccatccgtaccaatattcagcttagcggagcggatattaaggttgtaggcattacctctgttcaatcgaatgaaggtaagagtacaactgcggctagtctcgctcttgcctatgctcgttcaggttataagaccgttttggtggatgcagatatccgaaattcagtcgtgtctggtttcttcaagccaatgacaaagattacaggcttgacggattacctagcagggacaacagacttgtctcagggattatgcgatactgatattccaaacttgaccgccattgagtcaggaaaggtttcacctaaccctactgcccttttacaaagtaagaattttgaaaatttacttgcgactcttcgtcgctattatgattgtgttatcgttgactgtccaccattaggactggtaattgatgcagctatcattgcacagaaatgtgatgcgatggtgctggtagcagaagcaggcaatgttaagcgctcatctttgaaaaaagtaaaagagcagttggatcaaacaggcacaccgttcttaggcgttatcttgaacaaatatgatattgccaccgagaagtatggtgaatacggaaactacggaaattacggcaaaaaagcttaatttctcagataatataagtttgataagtaggtattagtatgattgatattcattcgcatatcatatttggtgtagatgacggccccaaaactattgaagaaagtctgagtttgataggcgaagcttatcgtcaaggtgttcgctatatcgtggcgacatctcatagacgaaaagggatgtttgaaacaccagaaaaagtcatcatggctaactttcttcaacttaaggaagcagtagcagaagtttatcctgaaatacgattgtgctatggtgctgaattgtattatagtaaagatatcttaagcaaacttgaaaaaaagaaagtaccaacacttaatggctcgtgctatattctcttagagttcagtatgaatactccctggaaagagattcaagaagcagtgaacgaagtgacgctacttgggctaactcccgtacttgcccatatagaacgatatgatgcactagcgtttcatgcagagagagtagaagagttaattgacaagggatgctatactcaagtaaatagtaatcatgtgctgaagcccactttaattggtgatcgaacaaaagaatttaaaaaacgtactcggtattttttagagcaggatttagtacattgtgttgctagtgatatgcataatttatctagtagacctccgtttatgagggaggcttataagttgctaacagaggaatttggcaaagataaagcgaaagcgttgctgaaaaagaatcctcttatgctattaaaaaaccaggcgatttgagggttggtttaaaactttagagtatcaactactttgttaggtactgtgaagtaaaatggagagagtatgattaatataaatggttatcgccagttacgtttggcgcttcttgaattaattgccgtattttttgctgtatttttaactagtcaatttccagattcggatcttaatcgaacaggcgtcttatctattttcgtattacatttttttgcttttaatctttctaaaatgtacgtagatattgaaaaacgaggttatctagcagaagtagagaagacactaacctatagcttaattttggcattactattaacgtttacctcttttatgttggtagatgaggttgaaatttcaagaaggggattggtctatttttcagcaattaattttggtctagtttatttgtcgaattgtatcattagaaactataaacatatatttctaatttcaaaggagcaacaaaaaaatacactgcttataactacttatgaacgttttcgattgatgagaggcttatttgaatcagaattattacctgctaaatatttggctggagtcgtaattttaggagaaggtgtagctagcttggaattgccagcaccgcttattcctttggaacaagcagtagactttgcaactcatgaagtagttgaccatgtctttattaatcttccaagtgaaatttatgatttgaaaagccttgtatcagaatttgaaatcctaggtatagatgtgagtgtagacatcaattcatttgattttcaagttttacgaaataaaaaaattcaacaaattggtgaccatagtattgttactttttcttcgaatttttataagcctagccacatctttatgaaacgactgctggacatttgtggtgcaatagtaggtttaattttttgcggacttgcttccattgtcttagttcctcttattcggaaagatggtggaccagcaatttttattcaaaagcgtgttggaaaaaatgggcgaatttttaagttttacaagttccgttcaatgtacattgatgccgaagaacgaaaaaaagaacttctgtcccagaatcaaatgcaaggtggcatgtttaaaatggataacgatccaaggataactccgataggtcagtttattcgtaaaacaagtctggatgaattgccacaattttataatgttttgatgggggatatgagtctagtaggaacacgtcctcctacagtagatgaatttgaaaaatatacaccgagtcaaaaaaggcgccttagttttaaacccggtattacagggttatggcaggttagtggtcggagtaatattacagattttgatgaggttgtcaaacttgatgtagaatatattgacaattggacgatttggtcagacgtgaagattttattgaagactttcgtagttgtgtttaagcgggaagggagtaagtagttactgtcaaaaatgaaaaaatacgattatctagttgttggtgcagatctgttcggagcggtctttgctcatgaggatgaaatctacaaccttcccgttcaacatgaatactttcaataaactgtggggcgtggtgccccctgctgaagcagtagcgaagattgcagtgcaacgagctgttttgggagaaaaagtacctgagaacttggaagaacaagccatctcactagttggtacagacatctatgaaaaattgatcaagtcctacacagaaaaacaataggaaaaccatgtacggagttaccagcctttatcatccgtcgtttacccgtgcgtttgacttatgataataactatttcaacgatagctaccaaggttttccaataggcggttacacgtagattgttgaaaaaatgttggatcattggatcatgagaatattggtgttgagacaaatgttgatttctttgccaataaggaagattatttatcagattatccgaaggttgtcttcacaggtatgattgatgagttctttgattaccaacttggtgaattggaatatcgtagccttcgatttgagacagaagtattggatatggaaaactatcaagggaatgcggttgtcaactacacagatagtgaaacgtcatatactcgtatcatcgaacacaaacatttcgaatttggtacacaaccgaaaaccattattacacgtgagtattcgaagacctggaaacgaggcgctgagccgtattatccagtgaacaataatcgtaacaacaaactctatactgcttataaacgcctcgcagaacaacaaaagaacgttatattcggtgggcggcttggtcattatcgttgctacgatatgcaccaagtcatcggagctgccttacagtgtgtgagaagtgaggtataatgaaaggagataaaactatgaaaaatatttctattttaggtgtcaaaatacatccactaactatggaagagactgttgaagttattgaagaacattttattaaaacgcaaaagccacttcatttaatgggggtaaatgctgataaaataaatcaatgtattgatgatcctgaaatgatggatattgtaaataattgtgacattgtgaatgcagatggtgcttcagttgttctagccggtaaatatctaggtattgatattccgaaaagggttgcaggcatcgatttgatgcagaaattactgacattatcagaaaaaaaggggtatactgtctatttctttggtgcaaaagaagaagttgttcaaaaaatgcttagtgcttttaaagtagattatcctaatttaaaagtagttggttatcgaaatggttattttaaggacgatgagattgatgctatttcacaagatattgctagtaaggcgcctcaattggtctttgtaggaattacttctccgaaaaaagaaatattgattgaaagattcatgagagatggcgtaaatagtatttttatgggcgttggcgggagtttcgatgttttatcaggaactatcaagcgagctccaatatggatgcagaaagcgcatctcgaatggcttttccgtgttgccaatgaaccaagacgtctttttaagagatattttgtcgggaattttgtttttattaagcgcatagtcaaggcaaagaaagagaagaaatgaaatgagtgaacaatttgatattagagagctccaagaaacgctgttagatgctgtaaaagagttcaaaaaaatttgcgatgaggaaaatattactttctttttaagaggaggcagcgtgatgggggccgtaaaatatggtggcttcattccttgggatgatgacatggatattgctgttccaagaaaagactatgttcgtttaattgaaatttttaataatcgagagattgcagggaaatataaagttttgaatagtaagtatcagccagagttacattgctatttcccacgcctatttttactagagtcggaacgagagaaattaggactaccttcgaatactcatctcggtttacatttaatagacattttaccattagatggtgctccaaataacaaagtttctagaaatatttatttttgtaatgtatatattttacgctttttggcaagtttaggaacaacttatacagaagggcatgttgacatgcatactgcaaaacaaaagttgttaatcaatactgctaaatgtttacaactgcataagctattcccgcagcaaaaagtttatgctatgcttgataaattatatactcgatatgattgggaaaaacaacaatatgctggtacaattacagcttctctgtttaaaaaagaggtgatgcctactgaaatttggggtgagggtattctacatcaatttgaaacagaggagtatcttatccccgctcagtatgatcaatatttaaaaagaatgtatggtgagaattatttgacggaggagcctgcgaataaaaaatcgcatcacgaatagaagaaagtaaaaaatatgatttgttttattatcttacactacatggtcaaggaagaaacgataaaatgtgtagagtccattttggaacgagaaatggataatatacagattattattgtcgataatctgtctcctaataattccggacaggaattatttgaatactataaagggaatgatattgtagatgtattattgaatgatgagaatgcaggatttgcgagcggtaataatgttggatatagttatacgaaagaaaagtacaatcctgattttatgattattatgaataacgatgtcgagcttgcttcagaaaactttgatgaaaaacttcgtgaagtttataaaaaagaagaattctttattctagggccagatatttattcaactacatacgaattacaccaaagtccaaagagacttgagcattatacttatcaggaagtattatcgcttcataataaatttaaaaaatcaaaagagattacattctctcttaaattaaagtcatggttaaaatcgaatgatttcctacgtactttcgtttatcaatcacgagtaaaaagcaaagatattgattttaccaagatttactataatgttccattacatggctcatgtgtgatttattcaaaattattcatagaaaaagaagagtttgcttttcaaccaggtacttttttctattatgaaacagaaatattagattatatttgctataaaaaagaatataagacaatgtatagtcctgagttgaaagttttgcatcatcaaaatgtatctacaaatgtagtgtataataatatgctcaaaaagaccatctttgctaataaatgtaactatgagtcgacaggagtatttttaaaagttatggaatcattccaagagaacggagtagatcagtagtggaactattactagcattatttataggattacttttattactcttctttaattatctctcctcccagcgagatatcttatctccatctgttgtaatggtcgcaatgtttattgtcagcacgctgttcgctctaatcaatgctaaaaactggaatattgattatgagccgctatctacattttacatactaagtggcataatcgtttttagtattcctgtaactatcgcttcaaataaggtaggagctactcctgaaattgtatcttatcgaaaattatctatttcaacatggaagatcatttttgctattttagtagatatagtcatcatttatctatatcgtaaagaaatgtaccaattggcagcacaagcaggttataacggtcaaagcatacaatggtttattcgaaattctactagttatgaggggagtattgaatttagtgccaaaatgcgtttattagtgcgctttgttgatattacggcctacattttcatatttaccttcatcaataattttatctatgatattagaagaaagagtaatttgctattactggttccggtttttctatttatatataaaacttcattgaccggaggtagacaagatattcttaaattattagtggcagcaatcgtccagacctacattttacagaaagctaaggttggatggagaaaggttatttctggcagatacatgatgataggactcacaggtttgctgttcgggattcctagcttttattatggattatttttagtcggaagaacaacaacacgttcaatgatggaatcagtctctacctacattggtggacctattcagcattttaaccaatttgtgcagaatcctacatcaccatcaagatatattcgatcagagtcgcttactccgatattaaatatattaggtgatttggggctaatagactacaatgaaactgtacatttagagtttagacaacttggcgttacaattggtaatgtatatacattctttagacgccccttacatgatttcggaccagttggaatgtatttatttgtttttctggttggtgtgttatttgcatatctttattacgttgttatccgttcaaaacgtagaagtgatttgtgggatatgaatgtgatggtttactcctatttgttttattggattttcctatcatcaatagagcaatattctatgacaatcattagtgtatttactctgattgctattattctattttacttattatctattttttattggcaattcactttcacaccaagaggaatagcttttgtcagaagggataatgaaattcagagggaggaattttaaatgaaaaaaattatgttggtttttggtacgcgtccagaagcgattaagatgtgcccactagttaatgaattaaaatcatctgggaactttgatgtaaaggtttgtgtgactggacagcataaagaaatgtggcaacaagttttagatgttttccaagtcgttcctgactatgatttggaaatcatgcaacctaaccaaacgttattttctattacaacaagtatattggaaaaaattaaaacggtatttgatgattttcagccagatgtggtattggttcatggagacacaacgacaacttttgctgcttctttagctgcgttttattcaggaattaaagtgggacatgtagaggcgggattacgtacttacaatcttcaaagtccgtttccagaggagtttaaccgacaagctgtctcaattgtttctgattttaattttgcaccaactgatatttctagaaaacatttgctttcagaagggaagaatgaagatagtattttcgtcacagggaatacagcaattgatgctttaaaaactacagtgaaccctgattattatcatgaactgtttgattgggttggtgattctaaactgattatgattacagctcatagacgtgaaaacttgggtcagccgatgcgaaatatgtttaaagctattaaacgagttctgaatgagcatccagacgtaaaagctgtatatccaatacataaaaatccagttgtacgtgatgcagccaatgaaatttttggagatgatgaacgtcttaaattaattgaacccttggaagtaattgattttcacaatttcctgaacaagagttatttgattttgacggattcgggaggtattcaagaagaagcaccctcgcttggaaaaccagttctagttatgcgtgatacaacagagcgtccagaaggagttgcagcaggtactttaaaattagttggtaccgatgaagaagttatttacaaaaacttcaaactcctactttctgatgatgaagaatatagattaatgagtaaggcaagcaatccatatggtgatgggactgcttcaaaacagattgcagatattttattgaaaaatttataaggtactattttgaataaagaaaagatttttaatatattaaaaaattttggatatgtgatatcgtcaaatttattgacattgattgtgtcttcagttgttattctaattttacctaaagttattggtgttaatgaatatggatattggcaactgtatactttttatcttacttatattggattttttcattttggatggtgtgatggcatttatctaaaatttggtggagaaaattactcagatttagataaaaaatatttcgcttcccaagtgtcaagttttattatttttcaatcaattatctccttactaagtataatagcaagtttacttttttcaaaaaattcgtcaactttatttatttttttagcattatcattaaattttgttataacgaatactagattgttatttatatatacattacaaacaactaatagaattaaagaagcatccattattacaatttcagatcgatttatctatgtgatctttttattgtttttgttgtttagtaataatacaagttttcagagaatgattatcgctgataatattgcccgagttatttctttattttgtgcactttatatttgtaaagatataacttttatttctgataggaagttagtccaaattaaagatagttgggataatattaaagttggtagtaatttaatgcttgccaatattgcaagtagtttgattattggtgttgttagatttgcaatccaaaaaggatgggatattgcgacttttggaaaggtttctttgactctaagtctgtcgaacttagttatgacctttataaatgcaattgggatagttgtctttccaatgctaaagcgaacaagttcagataaacttgctttagtttataagtcaatgcgtttaatattgatgttaacgatgttaacgatgcttattgtatattatccattgaggattattctagaatactggttacctgcttataaagatagcttagaattcatgggaatggttttcccgatgattgtatttgaaggaaaaacttccttgcttttaaatacttacttaaaagctatgcgtcaagaaaaactaatttttaaaattaattttctaacaactattattagtatttttatggcagttttatcggtggtaattttgaagagcttatctatctcagtgctttctattgtgattttgttgtcttttaggagtacattgcttgaattgaaggttgctagattattaaatctcagcatattcaaagatttatttcttgaatttataatagtatttatttttatttgtggcaatattttccttgatatgagaatttcaattattctctatctcatttcgcttatgacgtattattttattacttttaataagaaaaatatttctttaaagaatcttctgagaacgtagtggaaatgtgtattatcaggaagtttcagttgcaattttagaaaattatatatatgtttaggtagtataatctgctagttcatgatataaagagatttttacagctctttatcaactgtagtgggtaaatgtcagctaacacctagagaggacgaaattcgttctctttttctttatgttcaaagcgattaaaatgcgtttttgaaggacggttactttcattctagaacagtgcctactattctctctattattgctaaacttgatgaaggttgtattgtctgttataatattggatattgcaagctttaagtgaaaggttttagggaagagattatcacaactcattctttattggctatgagacgatggtataaatgatagtctagtaaaagatttggagaaatgacttccttagaaagttaaatgtaaaaataatatgaaaaaatacgattatctagttgttggtgcagggctgttcggtgcggtctttgctcatgaggcagctaaaaagggtaaaaaaataaaggttatcgaaaaacgagaccacattgcaggtaacatctatacaagagaagtagaaggaatccaagttcatgagtacggtgcacatatcttccatacttctgaaaaggaaatctgggactatgttaaccaatttgccgagttcaaccgctatacaaacacaccagttgccaactacaagggcgagatttacaatcttccattcaacatgaatactttcaataaactttggggcgtggtgacccctgctgaagcagaagcgaagattgcagagcaatgggctgtattgggtggtaaaacgcctgagaacttggaagagcaagccatctcacttgttggtacagacatctatgaaaaattgatcaagtcctacacagaaaaacaatgggaaaaaccatgtacggagttaccagccttcatcatccgtcgtttgcccgtgcgtttgacttatgataataactactttaacgatacttatcaaggtattccaatcggcggttacacgcagattgtagaaaaaatgttggatcatgaaaatatcgatgtggagacaaatgttgatttctttgccaataaggaagactatttagctacctattcaaagattgtctttacaggaatgattgacgagttctttgattaccaacttggtgaattggagtaccgtagccttcgatttgagacagaagtgttggatatggaaaactatcaagggaacgcagttgtgaactacacagatagtgaaacgccatttactcgtatcatcgaacacaaacattttgaatttggtacacaaccgaaaaccattattacacgtgagtattcgaagacctggaaacgaggtgatgagccgtactatccagtgaacaatgatcgtaacaacaaactctatactgcttataaacgcctcgcagaacaacaagagaatgttatattcggcgggcgtcttggtcattatcgttactacgatatgcaccaagtcatcggagctgccttacagtgtgcgagaaatgaagttgggggaatgattttgagaagtcatcaaagtagtaattgattcttggcagaagttggaatgctcttaaaatgttaatcaaaaaaaccagaatttctggttttttgattattattgaattgctgccaacaagtcagctgcttgttgttcgagttttgttagagtttcgtcagataactccaatacacctgttccccatgcttctggattgatggttgaacctgtaaattcaccagcaatctgggtgcggataaatggaagaaggtgctggaagtctttgaataggtggtcgtgaccactgtttgcgacggcagagacagtggtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaagaacgcttcagcttttttggccatttgatggttaaaagaaccgtcacgtagtgaaccaactaaaaacaatacgtttgccatgatggcctccttttcataaaaacataaatttagtatatcgtatttgtcttttgttggcaatcctaggtctgcggattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcattggtatcgatagtcttgtagatataaccatctcgaatcatgttttttataacgacagtcatgttgccagatgtacttaataatttatcaattaagtcttgaattcgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtactttctatagcatagaggagctgaactgtgggtccaagttcttatattcgttctctgtctgaaggagaacgaaagtttattttcgtttttccatcgttcaatcaggcgacggttatcaattgtcaaatgtttgccttttggtgtataatgtttttgcatctctgtgcctctttcttgtgtttgtggtgaacaacaagtatagcacagaggtgttttcttttacctttaccttaaattggatttcatttgacaacaggaacccttgaaactgttttgtcagctaaactaaggttactattagcctttgctacttagtctaacagcttcaaacctgttatcaaatgaaattaccgacttactcaaagatagtgaaacaagtatttttgggtaagacgaggtggctaactttattatagaactttcaaaatgtaatggaaattgattttttgcaagtcattgtcataaaaatcagaaaatatttaataaatatgatagaatggaggtaatactagtttgaggtaaggatatgaaattaagaagaagcgtagaaaaactaaagggaac

SEQ ID NO: 42 - DNA, 27927 bp, Streptococcus suis
attacaggtgggctatctggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgtaggactagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagtttttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgataggggatgttcaaagcgtatttctctaaacaatcttttattttattccactgagcgtgataaatgtgatgaagatgctgtgtgttccgtgcaaacataccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatatagatgacatgattatctgtatcaagatagtgtaaagggaggctatgactagagtcgaaatccgccaaatagtcatcctcaatgatgtagacatcgtattgctttgctaattttacgatggctgtttttgttgctatatcataagttgaaccgagagggttgtgcaagcgaggaattgtgtagaaaaacttaatttttccagtctggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataactagctggtctttttttgtatagacatgatagtccattaacagactttgaacggaggaaatcaattctgctaatccctcttgctggtgatagtagttgaataggtaattttccctcccaataagactttcgtttagacaaatccgaaaatcttcatatggcaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcgatgttcctctattccagtcaaaatatcttggatgataacttgatattttttcatctaggcccccttttttatagactatgttattagctagtatataggaaaaattgaagaaagacaatatatgaatgatggggttgaggttcaggaattaagctactctatggtataattaagtgatgaaaataattatacctaatgcaaaagaagtaaatacaaatctagagaatgcctcgttttatcccctgtctgatcgaagtaagcaggttctggatgccataagtcaatttgatgtaaaaaagatggctgccttttataaattgaatgaagcaaaggctgagttagaagctgatcgttggtatcgaatcaagacaggtcaagcaaaaacctatccagcttggcaattatatgatggtctcatgtatcgttatatggataggcgaggtataggttcgaaagaagaaaattacctacgtgaccacgttcgtgttgcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcattggcttcgtcagaatttgagcaggtattttctccacagattcagaaaagattagttaaaattcttttcatggaagaaaaagcaggtcagctaaaagttcactcgactatatcaaaaaaaggtagaggaagattgctgtcctggttggctaagaacaatattcagaaattatcggacattcaagattttaaggtggatggttttgaatattgtgcttccgaatcaacggcaaaccaacttaccttcatacgatcaattaaaatgtgaaataatgaacaagataacgttttccagcactaaagaagggtaggaaaatattaatttctatgatataatgggtaagttataagtacaaaggaaggttgtttatgaaaaagagaagcgggcgaaggaagtcgtccaagctcaaattggtaaattttgcgcttttggggctttacaccattactctatgtttgtttttagtgaccatgtatcgctataacatcctagatttccggtatttaaactatattgtgacgcttttgctagtaggagtggcagtattgactggattattgatgtggcgtaagaaagcgcgcatatttacagcgctcttacttgttttttcactggtcatcacgtctgttggaatctatggaatgcaagaagttgtaaaattttcaatacgactaaattcaaattcgacattttcagaatatgaaatgagcatccttgtcccagcaaatagtgatattacggacgttcgtcagcttactagtattcttgctccagctgaatacgaccaagataacatcaccgctttattggatgacatatccaaaatggaatctactcaactagcaactagccccacaacctcttacttgacagcgtatcaatctatgttgaatggtgagagtcaagcgatggtcttcaacggagtttttaccaatattttagaaaatgaagatccagacttttcttcaaaagtgaaaaaaatatatagtttcaaagtgactcagactgttgaaacagctactgagcaggtgagtggagatagttttaatatctatattagtggtattgatacctacggtccaatttcatctgtttcgcgttcagatgtcaatatcattatgactgttaatcgtgcgacacataagattttattgacaactactccacgagattcatacgttgctatcccagatggtgggcaaaatcaatacgataaactaacacatgctgggatttatggtgttaacgcctcagtgcacaccttagaaaatctttatggtattgacattagtaactatatccgcctcaactttacttcctccttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgagttcaccagataatctagcgaattatcaagctattctaactggtttagaaggatctatccaaacagatttgagcttagaaacgatcatgggcttggtaaatacccaattagaatcaggaacacaatttacagtagagtcacaagcattgacaggaacaggacgctcagatttatcttcttatgcgatgcctggatcacaactttatatgatggaaattaaccaagatagtctggagcaagcgaaggcagcgattcagtcagtattggatggaaattaaaaaataggagaaaacatgaataatcaagaatcaaatacaatcgaaattgatgtattatcattattgaaaacaatctggagaaaaaaattcttcattctagtaactgcggtattaggagcagggctggcatttgtttatagcagttttctggtaactccacaatatgactctactacccgtatctatgtagtgagtcaaaatgttgaagccggtgcgggattaacaaatcaggatttacaagctggttcttatttggtaaaagactataaggaaattattctatcacaagatgtactgacgcaggtagctacagagttgaacttgaacgagaacttaaaagaaaaggtttcagtttctatccctgtcgatactcgtatcgtttctatctctgttcgtgatgcggatccaaatgaagcggcacgtattgcaaatagtcttcgtacctttgcggctcaaaagattgttgaggtcaccaaggtaagcgatgtgacgacacttgaagaagcagtcccagcggaagaaccaaccactccaaatacaaaacgaaatatcatacttggtttattagctggtggtatcttggcaacagctcttgtactggttatggaagttttggatgacagtgtcaaacgccctcaggatattgaagaggtaatgggcttgaccttgcttggtgtagtaccagattcgaagaaattgaaataggagaacaatatggcaacgttagaaattgcacgtacgaaaaaagaattggtaaataaaacagaagaatatttcaatgccatccgtaccaacattcagcttagcggagcggatattaaggttgttggcattacctctgttcaatcgaatgaaggtaagagtacaactgcggctagtctcgctattgcctatgctcgttcaggttataagaccgttttggtggatgcagatatccgaaattcagtcatgtctggtttcttcaagccaattacaaagattacaggcttgacggattacctagcagggacaacagacttgtctcagggattatgcgatactgatattccaaacttgaccgtcattgagtcaggaaaggtttcacctaaccctactgcccttttacaaagtaagaattttgaaaatttacttgcgactcttcgtcgctattatgattatgttatcgttgactgtccaccattaggactggtaattgatgcagctatcattgcacagaaatgtgatgcgatggtgcttgtagcagaagcaggcaatgttaagcgctcatctttgaaaaaagtaaaagagcagttggatcaaacaggcacaccgttcttaggcgttatcttgaacaaatatgatattgccactgagaagtatggtgagtacggaaattacggaaattacggcaaaaaagcctaatttctcagataacataagtttgataagtaggtattagtatgattgatattcattcgcatatcatatttggtgtggatgacggccccaaaactattgatgagagcctaagtttgataggcgaagcttatcgtcaaggtgttcgctatatcgtggcgacatctcatagacgaaaagggatgtttgaaacaccagaaaaagttatcatgactaactttcttcaacttaaagaagcagtagcagaagtttatcctgaaatacgattgtgctatggtgctgaattgtattatagtaaagatatattaagcaaacttgaaaaaaagaaagtacccacacttaatggctcgcgctatattcttttggagttcagtagtgatactccttggaaagagattcaagaagcagtgaacgaagtgacgctacttgggctaactcccgtacttgcccatatagaacgatatgacgccctagcgtttcatgcagagagagtagaagagttaattgacaagggatgctatactcaggtaaatagtaatcatgtgctgaagcccactttaattggtgatcgagcaaaagaatttaaaaaacgtactcggtattttttagagcaggatttagtacattgtgttgctagcgatatgcataatttatctagtagacctccgtttatgagggaggcttataagttgctaacagaggaatttggcaaagataaagcgaaagcgttgctaaaaaagaatcctcttatgctattaaaaaaccaggcgatttaaactggttactctagattgtggagagaaaaatggatttaggaactgttactgataaactgttagaacgcaacagtaaacgattgatactcgtgtgcatggatacgtgtcttcttatagtttccatgattttgagcagactgtttttggatgttattattgacataccagatgaacgcttcattcttgcagttttattcgtatcaattttatatttgattctatcgtttagattaaaagtcttttcattaattacgcgttacacagggtatcagagttatgtaaaaataggacttagtttaatatctgcgcattcattgtttttaattatctcaatggtgttgtggcaggcttttagttatcgtttcatcttagtatccttatttttgtcgtatgtaatgctcattactccgaggattgtttggaaagtcttacatgagacgagaaaaaatgctatccgtaagaaggatagcccactaagaatcttagtagtaggtgctggagatggtggtaatatttttatcaatactgtcaaagatcgaaaattgaattttgaaattgtcggtatcgttgatcgtgatccaaataaacttggaacatttatccgtacggctaaagttttaggaaaccgtaatgatattccacgactggtagaggaattagctgttgaccaagtgacgattgccatcccttctttaaatggtaaggagcgagagaagattgttgaaatctgtaacactacaggagtgaccgtcaataatatgccgagtattgaagacattatggcggggaacatgtctgtcagtgcctttcaggaaattgacgtagcagaccttcttggtcgaccagaggttgttttggatcaggatgaattgaatcagtttttccaagggaaaacaatccttgtcacaggagcaggtggctctatcggttcagagctatgtcgtcaaattgctaagtttacgcctaaacgcttgttgttgcttggacatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatataatccacatgaagcagtgaagaataatatttttggaacgaagaatgtggctgaggcggctaaaactgcaaaggttgccaaatttgttatggtttcaacagataaagctgttaatccaccaaatgtcatgggagcgactaaacgtgttgcagaaatgattgttacaggtttaaacgagccaggtcagactcaatttgcggcagtccggtttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatatttgtcttggatatgggcgagccagtacaaatcctggaattggcaagaaaagttatcttgttaagtggacacacagaggaagaaatcgggattgtagaatctggaatcagaccaggcgagaaactctacgaggaattattatcaacagaagaacgtgtcagcgaacagattcatgaaaaaatatttgtgggtcgcgttacaaataagcagtcggacattgtcaattcatttatcaatggattactccaaaaagatagaaatgaattaaaaaatatgttgattgaatttgcaaaacaagaataagaaagtaaaaaatatttttactttcctagagtttaaacgatgtttaagttctaggaaggttagaatacctaattaacaacaatattactatttattaagagtcagataatagcaactaagtgctacaaactatctttataataagtatatttggtcaaaagggagatgtgaaatgtatccaatttgtaaacgtattttagcaattattatctcagggattgctattgttgttctgagtccaattttattattgattgcattggcaattaaattagattctaaaggtccggtattatttaaacaaaagcgggttggtaaaaacaagtcatactttatgatttataaattccgttctatgtacgttgacgcaccaagtgatatgccgactcatctattaaaggatcctaaggcgatgattaccaaggtgggcgcgtttctcagaaaaacaagtttagatgaactgccacagctttttaatatttttaaaggtgaaatggcgattgttggtccacgcccagccttatggaatcaatatgacttaattgaagagcgagataaatatggtgcaaatgatattcgtcctggactaaccggttgggctcaaattaatggtcgtgatgaattggaaattgatgaaaagtcaaaattagatggatattatgttcaaaatatgagtctaggtttggatattaaatgtttcttaggtacattcctcagtgtagccagaagcgaaggtgttgttgaaggtggaacagggcagaaaggaaaaggatgaaattttcagtattaatgtcggtctatgagaaagaaaaaccagagtttcttagggaatctttggaaagcatccttgtcaatcaaacaatgattccaacggaggttgtcttggtagaggatgggccactcaatcagagcttatatagtattttagaagaatttaaaagtcgattttcattttttaaaacgatagccttggaaaagaattcgggtttaggaattgcactgaatgaaggtttgaaacattgtaattatgagtgggtttgcacgaaatggattctgatgatgttgcatatacatacacgttttgaaaagcaagttaactttataaaacaaaacccgactatagatattgagatagatgagttcttaaattctactagtgaaatagtttctcataaaaatgttccaacccagcacgatgaaatattaaagatggcaaggcgggagaaatccatgtgccacatgactgtaatgtttaaaaagaaaagtgtcgagagagcaggggggtatcaaacacttccgtacgtagaagattatttcctttgggtgcgcatgattgcttcaggatcgaaatttgcaaacattgatgaaacactagttcttgcacgtgttggaaatgggatgttcaataggagggggaacagagaacaaattaacagttggacattactaattgaatttatgttagctcaaggaattgttacaccactagatgtatttattaatcaaatttacattagggtctttgtttatatgccaacttggataaagaaactcatttatggaaaaatcttaaggaaatagtatgattacagtattgatggctacatataatggaagcccatttataataaaacagttagattcaattcgaaatcaaagtgtatcagcagacaaagttattatttgggatgattgctcgacagatgatacaataaaaataataaaagattatataaaaaaatattctttggattcatgggttgtctctcaaaataaatctaatcaggggcattatcaaacatttataaatttgacaaagttagttcaggaaggaatagtctttttttcagatcaagatgatatttgggactgtcataaaattgagacaatgcttccaatctttgacagagaaaatgtatcaatggtgttttgcaaatccagattgattgatgaaaacggaaatattatcagtagcccagatacttcggatagaatcaatacgtactctctagaaaaactattgcaagcttggccatcggggtatcagactgcatacagggcagaagtgctaggtgatatgataaatagagagttttataaatttccgtattttcaatttcatgatgtattatttgggatgcttgcgtgtgtttatggtgacgtaatagagatagattcaattttagatagtcatcgtttacacttaaataatgttacattatcctctagtagcaagtcgtttcacaattctttggggagtcgtttagattactatatgaaaatgtataatcgctatgattttgttgcccaggttgcttgtgatggagaaaatgatgatgtagaaaggatttctaaaaattattatgagctttatactgcaagatataacttcattaaaaattggaatatctattctatacttaaattataccaattaagaaattattataatggtaaacgagcgtttataagtgacattgtgtacgcacttcgtctacatagcgtatttgggatgattgtaagtaaattcaggagataggaatgagaagtacatcaaaaattgagtgggaactggctttagataaagcatttcaaggaatgtatcagactatagatgctgagcaattaaaaaaattacaacaagcatatttagatatgtttgtcttgctaaataaaaagtgtcagaaaattggaataaagcctatgatggtagcaggtacattaattggttctttaagacacaacggctatatcccatgggatgacgatatagacttagtgttaccaagaagtgattatgagaaatttaaaattgcaatgaaggatgacgatgattttttcataattgatccggcacaaaatcgtagtagtatccacaaaatgttaaaaattcagagtaaatcactgacattatttgacgtgatgggagaggggtttagtaaaaagaaatatctatatttagatatgttgcctatagattatgtttctgataataacttgaaaaataaagttgtcggcagtttatttaaaatcctcgatttatcgtattcgagttcaaggtgttttaagaaatattctccacatctaagttatatggcgacaaagtcaaaagaattgaagggaaatttatttattaggaaatgtattggcttgccatcatatctcattggaccacatagagtgtttcaattaatggaaagattattaaaatcgacaaaaaatggtaagagtatgaccattgcttatggtgtaaaaggatattttggagaaattgtctctcataaagtttttttaccagaagaaaagtattggtttgaaattgactacttttatggtccaaatgatgcgaatgcgtatctaaccaatcgatatggagattatatgaaacttccttcgaaagaagaacaagtggaaagacatattcgattgagagacgattgggaaagtaagataagataggtataagaaaatatgttattttttatagcgataatattgagcagtacttcttttttatttagaaaatctagttttgtttttggagtctgggcgctattttttattatattatttggttataatacatataatccggattatatatcatattcgaatatttatagattgtttgctttaggaaattatgatgggaaattgggagatattgggtatataagtttaatgaaagtaggtatatctcagcaattactattccaacaatttctacagatattagcaattattacaattcttctgttgttttattctatagataaattgagtgagtataaaaacttagtatgtgttttgatactactataccctttgacaattagtatagtccaacttagattttttattgcatatactttggtattgttaggattatactttctaaataaatcgtcaatcgggaaaattctattttttatactagttattgtagcaacaacccttcatttttcatccattatttttttagttctttttttaacgcagtctaaaagttttaaacatatttatattagcttgataggagttttaatagccctactgtcgataaattatttgaatagttttatacaaatccctttaatttcacaggcaattcaaaaatattttgtaacaagcttagaattcaaaggagtagtctttgtttctagagtggtattttttcgattaggaccagtattatttttacattccctatatatgtattttaagcattgttttgaagatagagatatttttttaatgaaagctactaatattatattagtaattagtatgttttttgaagtgataaattctgagtttgaacgtttttctagattaggatatatacttttttatattatagtgttaaacgtttgttcgagaatgaaattgaaatataatagggaaataattctaacactattaattattttctctctaactaatttttggtttcaaaatttttatcgaagctcaggtgggattcaattctttgacagtgtatttagagcgatttttgaaaataatttattattagattaagtatttgagtaaaaatgaaaagtttaattaaaattttaagaaagataattaagagcggtagagtaaagcaacttataagtaatagacttgttttcttcacggctttccaattgctacttcaacccaaaactaagaagtccttagaaattttacaagtttctatagaccaaaaaattatgcgaaaactcaggaaaaaatataaaacagatatagaatattttaaagctaacatcaacaatttcaaatataaagaagatagcgacgagaaggtagtgtgggttctgtggtatcaagggatagaaaatgctcctaaattggttaaacattgttttgaatctttaaaacggaatttgcctgaggataaaaaaataatttccttagatgaaagtaatctatcccaatatatcgacttacctgtattcatagtagagaaatttcattcaggaaagatttcacatgctcatttttcagatattgttcgtattgaattattatcaaaatatggtgggacatgggttgatgcaacagtgtttatgagttctcccattattcatgattatttttttgaatctgatttatttttgtttcaagaattacgcccaaatacatttggacacagtaggagaatatctagttggtttatgactgcaaaagccaataatgagattatattattgacgagatttttattgaataaatattgggagaaaaacaatagcttgcttgagtattttctattgcattgtttttttgaaatggctatagaagcatatcctgaagtctggaaagaggtaattccgtatagtaattcgcacccacatattttacaatttaggatgtttgataattttaataatcagcattggcatgagatttctagcatgatagaagtacataagctaacctataagtatgaacaaaaggattacaaaggaacttaccttgatgaagttattttacaagaacatgtgtaataaaaagagggagaagatatggtagtttcagcagtcattttcgcaggtggttctggttcgcgaatgaaaaccacgacaaagccaaagcaatttctagaattgcatggaaaacctattattattcatacgattgaacattttgagaatcatccattggttgatcaaattgttattgtatgcattgagggatggattgagtatttagaaacactgctttctaagtttcaaattaaaaaagttgtaaaagtagttccaggtgggacaacaggtcagatgtccatttttaatgggcttgaagcattgtctgggaatatagaaaacgatgacattgttctgattcatgatggtgtgcgtccacttattgatgcagaaattattacgaacaatattgagtgtgtaagaaataataggactgcaattactgttaagcctgttattgaaacagtcattcaagtgaatgaagataatgctattacaaatgttgttgatagggattcctgtcagactgcagtagctcctcagagtttctatcttgcagatatttattcactacatttaaaagcacaagaagatggtttaatcaatatgactgattcagcaacattggttcgtcattatggtctagatttatttaccgtgatgggaggacctgagaacataaagattacaactccttcagatttttatatttttagagctatttacgattcaagggaaaatgctcaaatttttggatagggaataatatgttagattcaactttagaaaaagactgtatagcttttgtcagagaaaattcagaattgctaactgacttgactaataagacggtttttgtgactggggctacaggtttaatcgggagtcacttagtttactcgcttgtttttgcaaatcgtctattacagaccaatataaaaatagtggccgctgttcgctctaaagaaaaggctatgtataagtttgcggattgtctgagtgagatcgacttccatgtttcggatattagtcaagaacaatcttatgctggggatatagattttattattcatggtgcaagtgtgactgcttcccgtgattttgttgaaaaacctgttgatactatttttactgcgctaaatgggacaaaaaatattttagagttagcaaaagtgaagaaagtaaaaaaggttgtctatctgtcttcgcttgaggtctatggaataaacgaatcgaaagaatcaatatcagaagatgattatggctatattgatttcactcaggttagaagtagttattcagaaggaaaacgaatggcagaatgcctgtgtgtttcctacgcaagccaatttcaggttccagttagcttagctagattaacacaaacttttggaccaggtgttgaatatcaggacaatcgtgtgtttgctcagtttgcccgtgctgttattgaaagcaagccaattacattgcataccaaaggtgaaacaatgcgtagttattgttatacaaaggatgcagtagctgcaattatacatattttacttaagggggtctctggacaagcatataatgtagctaacgaagatacctatacctcaatttatgatatggctatattggcaagtcaacttgatgaaaataatatttgtaaagttaaggttgatttacaagatattaatcaactaggatataatccaactgttaaaattaatttagaaactaagaaactaaaggaattaggttggaatccgacagtgcagttaaaagctatgtttcaatcattaatcacttctatgaaagtgaataaggagaaccattgaaaaagttattgttaaactctagctatgctattacatcaaatctgttatcactacttgtttcaaccttagtcattctcattttacccaaattaattggagttgaggaatatggttattggcaattgtatcttttctatacaagttatgttggatttgctcatttaggttggattgatggtatctatctaaaatatggtggtgaagagtatgagcgactggataaacaaaagtttttctcacaattcattgcctattctctttttcaaacaataattgccattctgatttttgtcgtaggcaatagcatagatgtcgggacgaataaagaatttatcttcaatatgctatcactaaccttgctagcaaccaaccttagattttttgttatttatttgttacaaacgaccaatctaattaaagagagtgcaagaataatgattctcgatagagttctgtacatctgtttattgttgggactaattgctggtggtatttacagctataaattaatgatagtagttgacgtgattggacgatttatttctcttttttacggtatctatctttgtagagatataatagttcacaagcttactttttttaagtttgatatttcagaggttattgataacataaaagttggtagcaatttgatgctttcaaatgttgctagtatgctagttattgggactgttcgtttgggaattgagaagcgttgggatgtagcaacatttggaaaaatttctttgacattgagtatttctaatttgattatgacgtttatcaatgcggtaggaattgtcatttttccaatgttgaagaggactgaaaagagtgagttacccgaattatatgtaaaaattagaactttattaatgcctgttttgttgggatttttattattattctttccacttagaacagcgttaatgatttggcttcctaaatatgcggatagtttgctatatatggcgctaatttttccgatttcggtatttgaaggtaaaatggctttattaattaacacatacttgaaagctttccgtatggagagaacaatactatttgttaatttgttaagtatgctcttaagtgttctattgactattgttacaacttttatttttcctaatttaatattggcaacgctttctattaccttcctactatttttccgttgttttcttgcagaaatattgttagcaaaaagcttagaaatttctgttgctttagatgctctaatagaagcaatcattgcggtaatatttatttttgctgcatgggctctaccaagtttggcaggatttttagtatacttggttatttatattatctatatgtggataaagatcggtagtaataaaagcttatttacacgattgaaataatcagagtactgagtatatgaggtaattttgaatgcccaattacgattatttgcagctctttatcaactgtagtgggtagatgtcagctaacatctagagaggacgaacttcgttctctctttctttacgttcaaagcaatcaaaatgcgttttttagagttttcatcttcctgaaaccaaaggcatttcttttaattactttgatgagattgttggtagcttccagtttggcgttggaataaggcagttctaaattagtcaagtacatccgaaacatggaaggttagctttgtttatcctgtgacctatttcagatggtaatttttaaaacaggataaaagcccattttttcaggatttagtcaagtaatcatagcattaatctggacaaactttagtggacatctttagatgttgctggagagaaatacctcatagttagtgtaaaaaccacccattttcacgggtggctatgatttatgtacgaagtaatggtgtaatttgattaagagggttgtgctcacttagaatttctacctgcttgctttgagagacatgggtgtagatttgtgtcacattgatgttactgtggcctagtaaatgttgtatttgtcgaatatcgacgccattatcaagtaacatagttgcaaaactataaactgcatttgttttatagagtttattaaaattttgggaactatatgtctgtttacactaaccacaatatatatatatagtatctacaagaacatcaaaaaaggcgacttccaagctaggaaatcgtctttttgtatttagatattttctgaatatggtaaagtttggatataattttcaatccatctccaatcaacttctttattgtgatttactggtaacaataattttgtttttttaattaaatccatcttaaatgctcttccgtatgaatatctatatctttcttgattcagtagagtttgaataaatagccccgtatatttatttaaccaatttgctctaattacaacaatgtggtcacccgcaacaaaaggattaggttgataagaaatagttgatgtcgtatcgcctatcacaagtgcattgcctttttcgataccattttcctcatcttttgaaacccatccatctatagaattatttaattctgttctactgacaaatggtaatttacttggttttcgatttttagaaaaatccatatcaatttttgtatgggctttagctttgtatatatcaatacctagttcttctaatgtaaatgaaacccagttttgggaagaaatatcaacataagtgtttcttttagtttcaggcagtttatactttagtgatttgatgaagttttccataaaatcccaatctggtataaaaccagaatcggagtatcgtttacttacatcaagaacaggttctccattgggctctttttgaataggaagttttaatctggagtatttcattctttttggacgccatttccgtccatatccccatctgtacctatcgtgcattattactgttgcaatgaatagagctgtaaattcattgaagtcaccgtcaattctatataaaggattaacatcatgactacaagtgaatagtttttcttgatagtaagcatatcctacagaaccattgttagtgacacagagagcatatggggggaatatcttatcgcttaattcctgattaggttcttctcctgtcttagaagcggattcgatttcttctaatgtgaaataatctgtaacaccgttatttttatcagtagcgcctataaaaggaatagttcccactccactagattctggtttcttattataaaaaccgttctccatacgaaataccttagaaaaatcaaaaaattcccaatctcgagtatcaatcattgccacattctccttctttaaccaagaaagatagataatgatttatagttcgttgaaaatcatcagagttaagtgttgaataatcggtttccatataggcttctgcaagccattcatcttcatatccaacttttttcataacagatagaccagccatttcacgtttatttctatacaatgatagccatttggattttacttgttcccataagctatcaccgttgctatcaactttctcaacacgacctaagcctttccttttgataaaattatcatctttaaaatacccaaagaaggtatccttatcagatttagtatgattttgagataaatcaaatatcatacagcaagcaacagctgaagcaccgggatagaacatttcatcaggtaaagaaaagacagcctctaaagtatatttttcaagcatctttttcttatataatttagtttctttgctattgccaatagcagcttgcatgggaagtaaaacagcgattttggcagttttattcttaatagtcttatcttcgccttgaccagttacttgccgagcgacccactcgacaaaatgaagtccttttgaagggtcttgtgtaacttttgaagcccatttttttgtatattcagggtcacaactctttttggtagcattatatggcgggttcataagaataacatctatgtttgcatctgtaatccatttccccttattaaacatagaatcctgaataatatttgaattaccatctccatgtatcaacatatttgttgatgatagaccgaatgctccatcttcatattctatgccaaaaatttgattctttttaacagccttacgttcatcctcagtattgcaatcatccatagcatctgtcattgcacgtactaagaaagcaccactcccacaacatgggtcgagtacacgagaatttttattaacattgacaaccttactcataaaatcacaaatatgatccggagtaaaagcctgatttttatcggattttcctacgtatttgttaaaagttgtaaagaagagatttaataaatcttgccctgctgtatttttatcattgatataagggataatattattgtctatataggctaatagagctgttaattcctgataactcagactggttacatcttggtcttccaacactttgttattgagtatcgctaacttaccaactttatttaaccccccaccttgagagagcaatccttctaaaatatttttgatactttttaggatagcttgttcaggagataaatcatttccatcggtatcttttgtaggttttataccttcataaacaagtccatttttaagtgctaataaacaagttcctacaaattgacttcgtaatttctcagcaaggccgtcagaatgtaacatttcattcaatactttaattgaatctactacttgtaatttgtcgtttacttttccaaaacacagttcttcatattcttcaaacgatagaactgttgttagttcagtattcatgtgttcatcatcaataattactgattgaccataccatgtccaagtgtcattaccttctgtctcagtcaaaatagctacaatttttctatctgaatatgccttttcatactttacatattcttgtaattgtttctgaatttcaatcttatcccagttatcgaatctatcttttgtttcaaccaatatggctaaacggtcattctcaaaacgaatatctatatggttacgttttttcgttgagttactatttctgtagtcagaaatagatttacctacagctttcaatcccttagaataactaaattcaccattttcaagattagtggagtagtataatttgcctattttatcaataatttcaaaacggttcatcataacacctcgaaattattgataaaataaatagcctcctcacaaaaacgtgaaaaagcctgttttaggggttgacaaaaaacacgtccgattacataatcagcgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgagctgtgattgcattcatacaaatcaattcctttgctatttttataaaactattatatcacaaaaggtaatttccgaaaagaagtatatctatatttacactggtttgttgatttttatgttttaagtgatataatgattttataatacagaaggagtacagaagtgttaggtgaatttgagtcattgtatgatttgatgaatgcttttccaaatgactattactgtgagcaacatttagaaaaaattcgttggaatggttatgtagtcagtccttttgatgaaacatctaaagtctataaatgcaagaatggtaaatacagatgtaaaaacactggtaaatattttaatgttagaactggtacaatgtttgataatactaaagtctcccttcaaaaatggtttatagctatctggctaatggcctctcataaaaagggcgtctcctctctacaactatcaaaagacatcaacgttacacaaaaaacagcttggtttatgctagagcgtattcgtagatgtttcagttcagaaaataataataaattggacggaactgtagaagtagatgaaacctacatcagtggtaaaaataagaatcgccataactcaaaaaaagttaaaaatgcctaaggtctctccctaaaagataaaatcccagttgttggtatgggtgcacgagaaggaaaattgaatgctcataaagtaaccgatacaggcacaaaaactttaacagaacaaatcgtaaaatttgtgaaagacgctgcccagctttacactgatgaatggttaggttataataaagttgcgaaaatgtacgactatgcttttgtaaatcatggtgctcgtgaatatgtaattgatgatgtttatacaaatacgattgaaggttttggggcaggtctcaaacgtggtgtactgggaatctaccattcttggtttaagaaatatctacaagattatgtagatgagtttgacttccgttataatacccgaggcatggctgacaacgactgttccaatcttctattgtcatcttcagaagttcgtactacatacaaggagttagtccatggataaactacatgcagaaatggagcgaacagtttctaaaacaattgataataagctagtagattatcaaatttctctctctgataatttttacaccaaatatcttagttactatgactgcccttacactcaggaagtagttaaatcacaccgtaaatttttccaagacttatcctactatgcgatttatcaaaaacttggagaggtaacaaaaattagtatacaggctcgactttctgagttagatactttagtagatatttcagacaataaagatgaatttgatattttcttttacaaaaagtttcagtttaaactacctgagattccatttgaggaagaaaagatagaactttccagttttgatttaaaattgcaacaggctctaaattattatcctaaagaagatgaggggctgagaaaaagaagataaggaaggtgcaagatggattggtacgactacatgataaaggcatcagagcaatcacggtttaatgctagtcactggtttcgctatctgcgaaaagttatttttgaagactattcttatttgacagaagaagatgtcgaaaagttattagcttctaaagaactaacagattttcaaaaggttagtttgaaatatgctattcaagagcatacaccaactcatgaatatgttgtttcgttaaataagcctgccaaattaaccaatgtacaaaaaatgatggagaaatacagacatggataaaatgaaacctgtttttgaagccttgaaccaagagttatctcaagccaatcttcatttaaccattatttgtgttggtggttatgttttagagtatcatggtttgcgagctacacaagatgtagatgctttttatgaagaaagtcagaaaatcaacgaaattattgctcgtgtagggcaacgctttaatttgaatactgacgaagaactatggctcaataataatgtggcaaacatgaacagacagccaccattacatttgtgtgagaccctatattcattcgaaaacttaactgttttagttgctccaattgaatacgtattgggtatgaagatggttagcacaagagagcaggatttgaaagatattggagcaattatcaaatacaaacacttccgttctccgtttaatacctttgatggtttgaagaaaatggggtttgatagcattgatttctccgttctcctagaaggcttcagtcatgcctatgggatggactggctagaagaattttttaaagaaaatcaggataaactgagaagatattattgatagtcaagatagaagaaaagacgatttcctagtttggaagtcgccttttttgatgttttcgaaatactacatattgttgttagtgtaaacatatatatagtttaaaaaattttttagtaaatgtttttagggtttttatagtcgaatgaattagctttcagacaaggaactgaggcgcaggctgtactagagtacggcaagtcgaaagtgacgatgtatcaaagctaattcaaatgactatatattatttatttcctactattctctctattattgctaaacttgatgaaggttgtattgtctgttataatattggatattgcaagctttaagtgaaaggttttagggaagagattatcacaactcattctttattggtaatgagacgatggtataaatgatagtctagtaaaagatttggagaattgacttccttagaaagttaaatgtaaaaacaatatgaaaaaatacgattatctagttgttggtgcagggctgttcggtgcagtctttgctcatgaggcagctaaaaagggtaaaaaaataaaggttatcgaaaaacgagaccacattgcaggtaacatctatacaaaagaagtagaaggtattcaagtccatgaatatggcgcacatattttccatacttctgaaaaagaaatttgggattatgtgaatcagtttgcggagttcaaccgctatacaaacacaccagtcgccaactacaaaggtgaaatctacaatcttccattcaacatgaatactttcaataaactgtggggcgtggtgacccctgctgaagcagaagcgaagattgcagagcaacgagctgttttgggaggaaaaacgcctgagaacttggaagaacaagccatctcactagttggtacagacatctatgaaaaattgatcaagtcatataccgagaaacaatgggaaaaaccatgtacggagttacctgcctttatcatccgtcgtttacccgtgcgtttgacttatgataataactatttcaacgatagctaccaaggtattccaatcggcggttacacgcagattgttgaaaaaatgttggaacatgagaatattgatgttgagacaaatgttgatttctttgccaataaggaagactatttagctacctatccgaagattgtctttacaggaatgattgacgagttctttgattaccaacttggtgaattggaatatcgtagccttcgatttgagacagaagtattggatatggaaaactatcaagggaatgcagttgtcaactacacagatagtgaaacgccatttactcgcatcatcgaacacaaacattttgaatttggtacacaaacgaaaaccattattacacgtgagtattcgaagacctggaaacgaggcgatgagccgtattatccagtgaacaatgatcgtaacaacaaactctatactgcttataagcgcctcgcagaacaacaagagaatgtcatattcggtgggcgtcttggtcattatcgttactacgatatgcaccaagtcatcggagctgccttgcagtgtgtgagaagtgaagttggggaatgattttgagaagtcatcaaagtagtaattgattcttgtcagaagtcggaatgctcttaaaatgttaatcaaaaaaaaccagaatttctggtttttttgattatgtgacttttagtccgtcacgctccgtaaggtgcgtgacaaataaaccacccgctatgcgggtgtgcgacgaaggttataccaaaaaaactccaaacgcgatacaataaaggtgttcaagcctattgtaaagcgagaggagaaaagtatggcacaaaaggcacatagtttatcacatacaaagtggctgtgtaaataccacattgtcttcacccctaagtatagacgaaaaatcatctataatcaatatcgaagtagtttgggagaaatattccgacgtttgtgtagttataaaggcgtagaaattatcgaaggacatctgatgccggatcatgttcatatgttagtcagtattcctccgcgattaagtgtatcaagctttatgggatatttaaaaggtaagagtgctcttatgatgtttgataaacacgccaatctcaaatataaatttggcaatcgccatttctgggcagagggctattatgtaagtacagttggacttaatgaagccacaattaagaaatatattcaagagcaggaaaagcatgatatagcacttgataaattgagtgtaaaagagtatgaagatccctttagggataatggcaagtagtacgaatgcctctttaagaggctagtgacgagtcaaaagcagtgaggcttgaacaaagtgaaagccagcgtctttaggcgctggctggtgatgtgggcttacagcccctgttcaaaccacccgtttgacgggtggtcatgattattgaattgctgccaacaggtcagctgcttgttgttcgagttttgttagagtttcgtcagataactccaatacacctgttccccaagcttctggattgatggttgaacctgtaaattcaccagcaatctgagtacggataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacaatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagtcaagaacgcttcggctttttttgccatttgatggttaaaagaaccgtcacgtagtgaaccaactaaaaacaatacgtttgccatgatggcctccttttcataaaacataaatttagtatatcgtatttgtcttttgttggcaatcctaggtctgctgattcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatcgtcttgtagatatagccatcacgaatcatgttttttataacgacagtcatgttgccagatgtgcttaataatttatcaattaagtcttgaatccgcagatttcctttgttgtagagtgcctccatcactccaaactgacaaactgtcagtccgtattttttgattgtttctaattctgattttgcgatagtattagctgctctgcgaaagacgactagactgtgaagtgcatgcttgttctcatttaaagattgttcaacagttctcatgagaatattttagcaataaatagttcggttatcaagcaaaaaaagttagatcctatatccataggtaaagtacttttatagcatggaggagctgaactgtgggtcccggttcttatattcgttctctgtctgaaggagaatgaaagtttattcacaattcaattacggaaaaaatggaaatatgctttaacttgtagtataataggactactatggaaaaaaagatttttcaacttttggaagtattggcaacgaagaagggacagctgatagctggttcctttatactcctaagtgtcatgactttttcgatatttgttatttgggaccttgcagctaagcctttttctgatgtacagagtcacgctatttctgtagctcgagactatgcggatatagaggctgttgatgatgtctctatctataatggggcagaaacatactttagcgtgcaaggaaagacgagtcagggagaaatgattgcagttatcattcctgaagagacaaatactgtgtacgtttatccaatggcgaatggtatttctaaggaagaagcgcaggcagtcgctacagagaatggtgctggagagatagaaaaatcggttcttggctacagagatgcgaagctgatttgggaagtcaagtcaggtactgcctactatttagttgaatttgaaacagggaactttatcaaacgggagggcttatgagcaagttatcaagacgagtcttagagatggaagaaagtgtaactctggcagcaggtgcgcgtgcaaaagccttgaaggcagacggacgtgatattttagagctgaccttgggtgagccagacttcgtcacaccgaaaaa

SEQ ID NO: 43 - DNA, 25729 bp, Streptococcus suis
attacaggtgggctatcgggtagttttaatgcggcacgagtagctagggatatgtatatcgaagagcatccggatgtgaatatccatttgatagatagtttgtcagccagtggggaaatggatttacttgttgacgaaatcaatcgcttaattggtgcaggattagattttccacaagtagtagaaacgataactcactatcgggaacacagtaagctcctctttgttttagcgaaggtcgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggaggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttttaagttcgagggggattgtttgtatgagactattggattttattcattcaaatatcttacgaattgctccagtttatctgcaaaatcttgttcaaagaagatctgtaagaaatctgctttctgtccgctgaaataataacacttttcaaacatgcgttggatgctaggcgaaagaatccccttgcttagctgaaaggtcacgctccctttggaaattcgatacgggatgttcaaagcgtatttctctaaacaatcttttattttattccactgagtgtgataaataagatgaagatgctgtgtgttccgtgcaaacataccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatatagatgacatgattatctgtatcaagatagtgtaaaggtaggctatgactagagtcgaaatctgctaaatagtcatcctcaatgatgtagacatcgtattgctttgctaattttacgatggctgtttttgttgctatatcataagttgaaccgagagggttgtgcaagcgaggaattgtgtagaaaaacttaatttttccagtctggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaattaattctgctaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtaaatcttattttggtattttaattccaacatagccttttggacagtgtctttgctacaatgatattgctcgctgagttgacggatagaaggtaatttctctccacgtttgaatcgatgttcctctattccagtcaaaatatcttggatgataacttgatattttttcatctaggcccccttttttatagactatgttattagctagtatataggaaaagttgcagaaagacaatatatgaatgatggggttgaggttcaggaattaagctactctatggtataattaagtgatgaaaataattatacctaatgcaaaagaagtaaatacaaatctagagaatgcctcgttttatcccctgtctgatcgaagcaagcaggttctggatgccataagtcaatttgatgtaaaaaagatggctgccttttataaattgaatgaagcaaaggctgagttagaagctgatcgttggtatcgaatcaggacaggtcaagcaaaaacctatccagcttggcaattatatgatggtctcatgtatcgttatatggataggcgaggtatagattcgaaagaagaaaattacctacgtgaccatgttcgtatagcgacagccttatacggattgattcatccttttgaattcatttcacctcaccgcttagattttcaagggagcttaaagataggcaatcagtctttgaaacagtactggcgaccgtattatgaccaagaagttggtgacgatgaactgattctctcgctggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcagaaattatcggacattcaagattttaaggtggatggctttgaatattgtgcttccgaatcaacggcaaaccaacttaccttcatacgatcaatcaaaatgtgaaataatgaacaagataacgttttctgatgtcgagcgtatctagaaaaatcttgatttctatggtataatagataagttataagtaaaaaggaaggttgtttatgaaaaagagaagcggacggagaacatcatctaagctcaagttgataaattttgcgctttggggactttacgccattactctatgtttgttcttagtgaccatgtatcgctataacatcctagatttccggtatttaaactatattgtgacgcttttgctagtaggagtggcagtattggctggaatattgatgtggcgaaagaaagcgcgcatatttacagcgctcttacttgttttttcactggtcatcacgtctgttggaatctatggaatgcaagaagttgtaaaattttcaacacgactaaattcaaattcgacattttcagaatatgaaatgagcatccttgtcccagcaaatagtgatattacggatgttcgtcagcttactagtattcttgctccagacgaatacgaccaagataacatcaccgctttattggatgacatatccaaaatggaatctactcaactagcaactagccccacaacctcttacctgacagcatatcaatctatgttgaatggtgagagtcaagcgatggtcttcaacggagtttttaccaatattttagaaaatgaagatccagacttttcttcaaaagtgaaaaaaatatatagtttcaaagtgactcagactgttgaaacagctactgagcaagtgagtggagacagttttaatatctatattagtggtattgatgcttatggaccgatttctacggtctcgcgttcagatgtcaatatcattatgactgtcaatcgtgcgacacataagattttattgacaactactccacgagattcatacgttgctattgcagatggtgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaaatgagttcaccagataatctagcgaattatcaagctattttaactggtttggaaggatctatccaaacagatttgagcttagaaacgatcatgggcttggtaaatacccaattagaatcaggaacacaatttacagtagagtcacaagcattgacaggaacaggacgctcagatttatcttcttatgcgatgcctggatcacaactttatatgatggaacttaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaattcttcattctagtaactgcggtattaggagcagggttggcatttgtttatagcagttttctggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggcgcaaaagattgttgaggtcactaaggtaagcgatgtgacaacacttgaagaagcagtcccagcggaggaaccaaccactccaaatacaaaacgaaatatcatacttggcttattagctggtggtatcttggcaacaggccttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtacgaaaaaagaattggtaaataagactgaagaatatttcaatgccatccgtaccaatattcagcttagcggagcggatattaaggttgtaggcattacctctgttcaatcgaatgaaggtaagagtacaactgcggctagtctcgctcttgcctatgctcgttcaggttataagaccgttttggtggatgcagatatccgaaattcagtcatgtctggtttcttcaagccaattacaaagattacaggcttgacggattacctagcagggacaacagacttgtctcagggattatgcgatactgatattccaaacttgaccgtcattgagtcaggaaaggtttcacctaaccctactgcccttttacaaagtaagaattttgaaaatttacttgcgactcttcgtcgctattatgattatgttatcgttgactgtccaccattagggctggtaattgatgcagctatcattgcacagaaatgtgatgcgatggtgcttgtagcagaagcaggcaatgttaagcgctcatctttgaaaaaagtaaaagagcagttggatcaaacaggcacaccgttcttaggcgttatcttgaataaatatgatattgccaccgagaagtatggtgaatacggaaactacggaaattacggcaaaaaagcctaatttctcagataacataagtttgataagtaggtattagtatgattgatattcattcgcatatcatatttggtgtggatgacggccccaaaactattgaagagagcctaagtttgataggcgaagcttatcgtcaaggtgttcgttatatcgtagcgacatctcatagacgcaaagggatgtttgaaacaccagaaaaagtcatcatgactaactttcttcaacttaaagaagcagtagcagaagtttatcctgaaatacgattgtgctatggtgctgaattgtattatagtaaagatatcttaagcaaacttgaaaaaaagaaagtaccaacgcttaatggctcgcgctatattctcttggagttcagtatgaatactacctggaaagagattcaagaagcagtgaacgaagtgacgctacttgggctaactcccgtacttgcccatatagaacgatatgatgcactagcgtttcatgcagagagagtagaagagttaattgacaagggatgctatactcaggtaaatagtaatcatgtgctgaagcccactttaattggtgatcgagcaaaagaatttaaaaaacgcactcggtattttttagagcaggatttagtacattgtgttgctagtgatatgcataatttatctagtagacctccgtttatgagggaggcttataagttgctaacagaggaatttggcaaagataaagcgaaagcgttgctgaaaaagaatcctcttatgctattaaaaaaccaggcgatttaaactggttactctagattgtggagagaaaaatggattttggaactgttaccgataaacttttagagcgcaacagtaaacgattgatactcatgtgcatggatacgagtcttattatagtttccatgattttgagcaggctgtttttggatgttattattgacattccagatgaacgctttattcttgcagttttatttgttttaatattctacctgattatctcagttagactaaaggttttttcgctaattacgaggtatactggatatcaaagttatgtgaaaataggactaagtttgatatccgcttattcattatttttaatcatttcaatgattctatggcagacctttagttatcgtttcatcttagtatccttatttttgtcgtatgtaatgctcattactccaaggattgtttggaaagtcttacatgagacgagaaaaaatgccattcgaaagaaggatagcccactaagaatcttagtagtaggtgctggagatggtgggaatatttttatcaataccgtcgaagatagaaaattgaattttgaaattgtcggtatcgttgatcgtgatccaaataaacttggaacatttatccgtaccgctaaagttttaggaaaccgcaatgatattccacgattggtagaggaattagctgttgaccaagtgacgattgccatcccttctttaaatggtaaggagcgagagaagattgttgaaatctgtaacactacaggagtgaccgtcaataatatgccgagtattgaagacattatggcggggaacatgtctgtcagtgcctttcaggaaattgacgtagcggaccttcttggtcgaccagaggttgttttggatcaggatgaattgaatcagtttttcaaagggaaaacaatccttgtcacaggagcaggtggctctatcggttcagagttatgtcgtcaaattgctaagtttacccctaaacgcttgttgttgcttggtcatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatacaatccacatgaagcagtgaagaacaatatttttggaacgaagaatgtggctgaggcggctaaaactgcaaaggttgccaaatttgttatggtttcaacagataaagctgtaaatccgccaaatgtcatgggagcgactaaacgtgttgcagaaatgattgtaacaggtttaaacgagccaggtcgaactcaatttgcggcagtccgttttgggaatgttctaggtagtcgtggaagtgttgttccgctattcaaagagcaaattagaaaaggtggacctattacggttaccgactttaggatgactcgttatttcatgacgattcctgaggcaagtcgtttggttatccaagctggacatttggcaaaaggcggagaaatctttgtcttggatatgggtgagccagtacaaatcctggaattggcaagaaaagttatcttgttaagtggacatacagaggaagaaatcgggattgtagaatctggaatcagaccaggcgagaaactctacgaggaattgttatcaacaaaagaacgtgtcagcgaacagattcatgaaaaaatatttgtgggtcgcgttacaaataagcagtcggacattgtcaattcatttatcaatggattactccaaaaagatagaaatgaattaaaagatatgttgattgaatttgcaaaacaagaataagaaagtaaaaatatttttactttcctagagtttaaacgatgtttaagttctaggaaggttggaatacctaattaataacaatattaccatttattaagattcagataatagcaactaagtgctacaaactatctttgtaagtaaatatatttggtcaaaagggagatgtgaaatgtatccaatttgcaaacgtattttagcaataattatctcagggattgctatagttgttctgagtccaattttattattgattgcattggcaattaaattagattctaaaggtccggtactatttaaacaaaaacgagttggtaaaaacaagtcatactttatgatttataaattccgttctatgtacgttgacgcaccaagcgatatgccgactcatcttttgaaggatcctacagcgatgattacaaaagtaggagcttttctacgaaagactagtctcgatgaattacctcagctattcaatattttcaaaggagaaatggccattgttggtccacgtccagccctgtggaatcaatacgatttgattgaggagcgagataaatatggtgcaaatgatattcgtcctggactaaccggttgggctcaaattaatggtcgtgatgaattggaaatcgatgaaaagtcaaaattggatggatattatgttcaaaatatgagtctaggtatggatattaaatgtttcttaggtacattcctcagtgtagccagaagcgaaggtgttgttgaaggtggaacagggaacataaaaaaggattaaaatatatgaaaagagtattgataactggtgctaattcctatattggcacttcttttgaaaaatatatcatagaaaatgatgttgattttgagattgatactttggatttattgaatccaaagtgggtagaatttgatttctctccctatgattctatttttcatgttgcagctattgttcataaaaatgaaaaaaacataaatccagatttatatttttctgttaacagagatttacctgtaaaactagcaaatatggcaaaaacacagggtgtgaaacaatttatatttcttagtagtatgagtgtttatggtaatcaatataaggaaatttcatttgatactaaagaaattccgacaacctattacggaaaatctaaactggaggctgaaaagttattagaaaaacttaattcagactcatttaaagttgtatttttacgccctccgatggtttatggaccaaatgcaacaggaaattattcaagactttcaaaattagctaaaataactgcaatttttccgaagattgaaaatcagcgaagtatgatttatattgataatttattggaatttgtaagaaaaactatcgaattggagttggaaggactttattttcctcagaacagcgaatatatctgtacaagtgaattagttcgcaccattcgagaggttaatgggaaaaacacaattcttttgaccatttttaacccttttattcgactactttcaaatagtggtcagtttaataagttgtttggaaatttggtatatatgaaagagatgtcaaattatgattttgattatcaattgatagattatagagaatcaattcaaatgtcagaaaagtaattgatagttaaatggagaattatggaaaaaaaaattctagatggaaaaaaaatattatttttctcacctgctttttttggatacgagaaaagaatctcagataaaatggtttctttaggagctgaagtacattattataatgaacgtccaattgaaactagtcttcaaaaggcttttttaaaagtgaatcctaatattttctcacgaatgacggaagaatatttttttagtattttaaaagaagtagagaatattgaatttgatttcatttttttcttaaaatgtgagatgccaaccaaaaagattttaagtaagtttaaagaaaaattttcaaactcagttttttgcttatatatgtgggattcgatttcaaatgtgattggaattgaagaaaaatttccattttttgataatatttatagctttgatttggaggatagtactaaatatgagtgcataaagtttaggccgcttttcttttctgatgaatatagggtaacgcctaatcagtactcgaaaaaatattccttatcatttattgggacaatacattcagatagatatcgtataatcagacaggtgaaaaatatcgtagatggatataaattaaattcttacttttacaattttttacaaagtaaatttattttttattattataaaataataaaaaaagaatttagagatgcgttgatatctgattttagttttgatcatcttagtagcaaagagattgcagatatcatcaatgaaaccgaagttgttttagacattcaacatcctaaacaatcaggtctaactatgagaactatcgaaatgattgggatgaataagaaaatcataaccacaaatccgatgattcgtcaatatgatttttataacccaaataatatattgatcattgataggtttgacgttgaaatagatttatcatttttcgaatctccatatcaagaacttcaaacagagatatatgagaaatatagtttggagcaatggattttggacatattaaataaggataatttgtagtatgaaattaagaaaaatcctgtggtggttacgtttaagatgtttggcacccatttttggaaaagttggaaaatcgtcctatttagcttcttctatttctattattggtgcaaaaaatatttttattggagataaagttcgagtttttccaggaaatcgaatggaaacttataacaatggaagtatacatataggagataattgttcaattggacagaattttcatgtaacatccactgacaagaaactgataattggttccaacacaacaattcttgggaatgtttttgttacaaatatagaccatgattatagaaatataggtgttccaatattggaacaacctatgctctttaaagaaacaataatcggtgaaaattgcttcattggatttggtgcctctattcaagcaggaacagtactgggaaaacagtgtatcgttggtaccaatgctgtggtacgcgggcattaccccgactattcagtgatagtaggtgttccggccaaggctatcaagagatataatgaggagacaggagattgggaaaaaatatagagaaagcatctatctcagtgattattccagcttataatgcagaaaatgttattgtaagagctctagattcagttagattacaaaccaggatagattatatcaaggaaatcattgtggtcaatgatggctctaaggatatgacagcatctgaagtcgaactttatacaaataagtatccagaacttaagattagactaatcaatcaagaaaatgcgggagtgtccagagcaagaaatatagggatgcaaaatgcaacaggaacttggattgcccttcttgattcggatgatgaatggtttgaaaacaaaattgagagacaaatagatgaaatcttacaaaatggtaatattgatttcataggtgggaatcacaccccatgtcctattagtattctaggacgtaaaatagatagtcttcacaaagcaagtgtgaaggaaatatgtataaaaatgtttccgcagacctctacagttttatttaaaaaagcaattttttctgaaattggtggttacgatgagtctcgacactatgccgaagatggacaatactttttaaaaatttgccaagcatacggttactattatttgccagagcaaaatgtccactatgatcgtggtaagcgagggtttggagttagtggattatctggtaatttaaaagctatgcatataggtaacttacaaaatttcaaagagcttcatgaaaatcatgttattaatggtttcttctattttttcattgtttcttatgaaaaaataaaatatcttagaaggaagatgatatcatggatggacaaatgaagaaattattaatatttgtaaatagcatgaatgcatttggcgggattgagcgtgtaatagctaatctttcaaatcgatttacaagctactatgatgttactattttggttaaagatttaccaaagtctgcttatcaattaaatgagaaagttaaaattgaaagtttaaattgtccacttattatgaatatgggatctagactgcagagaattctcagtgttcccatcaatagtatactttccataattaagttaagaaaatacttgaagaattctgactttgatgtagtctatacagcatttcctacgaatggttttgaagtatatttagcagaaaagtcatatcggaataaaatcgtcgcatctgaacatgcttcgtattatgcatacaataaagtatataaaaacttaaaaaagtacttatatccaaaattaccagccatttcagttccaactactatggatacagaaatatacaaggggtttggctataatgcagaatatatcccacatttaactacgtacgatagtattggtaatgttaataaagatagtcatacgattataaatgttgggagattgacttctgataaacagcagatgatacttttgaaaatttgggaaatggtcaatgatagaattcctcaacatgattggaaacttcaaataattggtagcggagaggaagaagaaaatttacgaagttatattaaacagagagagttagtgaatgtagagatgattccacatacatctaatatcaaagaatactataataatgccgaattgtttgtatttacttcaaaaatggaaggttttggaatggtattattagaagctatgtcgtttggtgttccgtgtatatcatttgactgtccaagtggcccacgtgatattatagaagataatagaaatggatatttaattccatgttatgatgaagaattgtttgccgaaaaaatttgtgagtatatacaaaaaaatagcgaattaaaagaaaaaatgcaacaagaggcaataaatactatcagtagttggaataatgaagaaattattcaaaaatggctttctctttttgctagtttggagaaaaaaatatgaaaacaattgcattttacttaccgcaatttcacacaattcctgaaaacgatgaatggtggggtgaaggttttacagaatggacaaatatgaaatcagctaaatctttatttgctggtcatcaacaacctagaattcctttggataaaaattattataatctattagacgataggactatggagtggcaagtaaatcttgcaaaacagtatggattatatggtttttgtttttatcactattggtttgatggtcatatgttacttgaaaaaccaatggaacagatgttacataatccaaatattaattttccttatacaatatgttgggcaaatgagccatggactaatgcatggaagtcagatgagaacgccaaaacattgatagcacaaagatatggcggaaaagatgagtggaaaaggcactttgattatctgctccaattttttagagatgaaaattatattctagttaatggaaaaccgttattggttctataccgtccagaaattgttgattgtttgaatcctatgttggattattgggaggaacttgccaaagaagcgggattcgagggaatgtgttttgcatatcagcaagtttcttactatttatcttccggtaaagatgaaagcagattcacatatagaatagagtatcagcctggatatgctagatacgattctcagaaaaatagtggtggtttgaaaagtaatttattatcttttaggacagcaattagggacttagtttcacgtgtggataaaaaactaggtacaaatattgtttctaagttaacaaagaattctcttgcttttgaagattatgatgagttatgcacagctatcattaatagaaaaggtgaagatgaaaaatctgttgcaggtatgtttgttgattgggacaacacacctagaagaggaaatagaggcagagtttgtctagggtctacacccgaaaagtttaaatattatatgacaaaacaagtcaaaaatgttcaagaaacatatcaaaatgatatgatattcatttttgcgtggaatgaatgggcagaaggtggctatcttgaacctgatgaaaagaataaatacggttatttagaagctttgaaagaaagtgttgaaaatgcataaaaataataactcaatactatcactaccacggaatgctattttacttttcggacttgcttgttttggggtatttcaaaactcattgatgcaaatactacctttgagtttaaaaagccagatatttctttctattatttttgtgttatttagttactattgcatttttaaagtactttggaaaacctatcgaactattaactttatttttatttttgttttactatctttcccatttgcttatggacaacatttggtttcattgtttgattcagattatttatttagatttcaaacatttcacattctagacggacggttacaagattctagtattataaatgctacttacttcattattgtgtttttaatactattgactgttggatatattctgtctaatacatattataaagagcaagtaattgtaaatgaatcaggtctaatggctgggaattcaatagttattttcatttcattattattcctattaatatcaatctatcctgcttttaaggaagttattgcacaatataatttgagtcgacagttttcttatcttgtaagacgccaactagaatctcaagaaaattactatgagttattaggagtaggaactagagaattatatttaggtaaatggtttttaccgtctatatacatgttattgttatcctttcaggatttaaggaaacgagtacttccatattctattttattagtatattcaataatttatatgttaacaggttctagatttactctgttaaaaataatattagtagtttttttaatagaatatatctggcataaatcaattacattacgccaaataaaatatctcccaatcgtttttattccactcattgttgcatttagtattattaccagtttacgaggggattctggggtgacctttgaggattttttaactaatgcaactttttatataaatggttctcctttaagtgctacactttgggaaacggggattacttttacttctgtcagcaacgttatcgataaggttccatctgttgtcccgttcttcattgggaaatcttatttaggtgcaattttagtgtgtttacctgcatttttgcgatttggttttactgacaataatattttcacaattagtagtactttttctccgttgtattatggaacaagaggatttggatatggttcatcaatatatgcggagcaattttataattttggctactttgctttaattgttgcaattttccttggaataataattggaaaattagagaagaaaatgtttttatatcaaaaacaaagaaatctctctcaatttctattaattgtttttattttaggagaattaatatattctgtaagaaatgatctatatgctataccgagaacagttttgattagtgttggaataccacttatggtaatttggttagttaagtcgcttttaagtttgagtaataaatgatataaaattttagtttggaggtttgtaatgaaagtactagttacaggcgctaatggttttttgggcttagggattgttgaagaattacttgaccgaggttgtcaggttgttgcaacagatatgaatctcgctttgtgtgataatagagcagagaagatagaatgtgatctatttagtgtttccgacccttttgaatattttggtaaaccagatatattactacatttggcctggaaggatggttttgtacataacgctgatagccatattctatacttaccacaacatcatattttccttcaaaaaatgtttaaaagtgaaataaaacaagttgctgttttaggcactatgcatgaagtaggttttcacgaaggaagtatcgatgaaaatactccttgtcatccacttagtctgtatggaattgcaaaaaatgccctaagattagatgcagagtatatgaataatttgaataataaaaatttaatgtggctcagaggtttttatatagttggaaaaacatctcacggttcatcaattttttcgaaattagtccaagcatctgaattaggtcaaaaggaatttccctttacaaaaggactcaatcaatttgattttttagattactctgagttttgtaagcaagtggtgtcagcgatattacaaaaagaaattacaggtgtaataaatatttgttctggtcaaccagaatccctttcaagtcgtgttgaaaggtttatcgatgaaaataatctaaacattactctgcaatatggagcatttccagataggccttatgattcaaaggcaatttgggggagcaataaaaaaataacagagattttgaatagtgaccaggaaaattaagattaacatagaaaatggacaaacatgaaatttaataagaaatatttgacagagagaggaaaatttacatattttattctaaaaaatctatatgaaaacaactctatttctcggaaattattttatttatatattaataaatttgaaggaggtcaattttattcgacaaccttaagacgtatatttaaagaaataaaaaatattgatgttcagcttggaacctatggttgttttacagaaggttttcgtccaaatgtaaaaattggggcatattgttctattgcaccaggtgttcaaagattggttggtaatcatccatatagtaatatctcaacatatccgttattttatagtaaagattttggagctttagagtcatctagatatgctgaacagatgttagttatcggacatgatgtttggataggtgtcaacgcaattattactggcaatgttcataatattggaaatggtgcaattattggagctggagcagtagttactcatgatgtagaaccctattctattgtagctggtgttccagcaagaaaaatcggaacacgattctccgagcctatacaagagaagttagatcaatctaaatggtgggaactaaaacctgatcaattatcttcaattgctgagattgcgaatcaaccagaggaatttattctaaaagtaaatgagattcttggggagaacgcagatgactagccaaatacaacgtcataattataaaaaaattagcacctattatatggtaggtactttgtttaatcaaggcatttcgtttcttacggtccctatttttagtcgattacttagtccatacgattacggagttgtaaatacttatacttcatgggtcgcgattgcttctatgataataagttgtgctgtctatatgggaattcgctctgcgttcgtcgagtttgaagaaaatattaatgatgtaatgtctacattaacaactctgacccttttgaatggagcaatttgtttaatagtaattggtatttgtattttcttcattgatatcaaaaatccagagctaatattattagggttagggaatgcagtaggacaagcccttttacaaaattattccatgtatcaaatgatgaagtttgattatcgttttagaacctttttgttagtatttccgaatctacttgcagtacttatttctttatttactgtatcgtacatattctctgattatcgttatttaggcagaattattccaacagctctgacacaattattttttggcctctttataacctatttgatttataggaagagtctaataatttggaacttttattatgtaagatttgcgctgaaaatttcattaccattagtgttacatggaatcgcacttaatattttatctcaatcggatcgtctaatgattacagcttttcgaaacgctagtgaaacagggatatatagtctagtgtataattttgggatgttggctacagtgataactacaggactagatggagtatgggtaccatggttcacaaacaaattaaaaaataacgaagagtcaataataaatactcaagttaaatattatattgactttatgactttcgcaatgtgtggattaatattaataggaccagaaataataaaaatcttggctggtcgagattattggaatggaatagggttggtgccaccaattgtattagctaatttattaatttttgcatatacactatatgtaaatgttgaacactattacaaaaagactgtttttattacaataaatacagttattgctgcaactattaatctaattacaaattatttatttattcctaaatatgggtactttgctgctgcatttactactttgttttcatatggagttgcattttttttacatgccaattattctaaagaattaaatcgagatctttacccaatttcatattttatatttccgttttttaaaattttaggtgtagtcattattttctacatatttgtagattctattattatacgatggttgttcgcagcagttttgtttttatttgaaatttttcaatatcgagaacttattatcgagcaaattaagcaactaaagaagaaataagttagttattatatcttaataaagaaggaaagaaatgaaaaaggtagctgtctatttaaagaatgggataataaatagttttgttctaattctgaatttatttatacgtagagatcaatcaataattttgattggtagctggatgggtgaaaaatttgctgataattctcgatttctatttcaatatcttcatcaagaaaaacaagaattattgttaaagcgtgtaatctgggtaactagaaacaaaaatctaaaagatgaattaaatgagatgggatacgaagtttatctttgtggaagcctaaaaagtttttattggcatttaaaatctggcgtacatattctgtgtaatgcaatttatgtattacaagatggaagatttcttccagatattgatacttcattatcctttggagctaaacggattcaactttggcatggaattgctatcaaatcggtcggtgcagcatccaatgaatcccaaaaattaatcaaagataagcaaagtaataatatttcttggattaaatattttctttctcgtggcgggtgggcagattattttctcctatcaacaagtgagaaaaataaggaggataattataagatatctcgatgccaaattgataatatatttatttcttcttatccaaggacattttcatgtttagaggtactacctagggaaaaagcagttatagaagaaattagtaaattctcaactaagctaatctatttaccgacttttcgaaatagttataataactataagcatcctctaacagatccaaatatagttgaatttataaaacgaaatgatattttatggattgaaaaacaacattctgcatcgaattttgctagcacagactttttaaatttggaaaatgttttttgtcttgatgagaattttgatgtcaatgttctttatgaacatgtggatatagttgtttctgactactcttctgcagtgtttgatgctatttatcgagaaattccagttttgatgtatacgccagatttagaagaattcaaaacaggaaatgttggattattatttgatttagaaaattattgtagttcgttcattgtatatgatactgatcaattaattgatatgataaacgaagtaattaaaaaaagatatttcaatgagcaacgcttagatgattatagtaaaaatatggagttattttacgataatcgacattctacatatatagagttttggcaagtattaactgccttataggaaggagaaagtttatgaaacgcgtgattacatatggtacttttgatttactccactatggtcatattaatttattaaaaagagctaaggaattaggtgattatttaattgttgtaatttctacggatgaatttaattggattgaaaaacagaagaagtgttattttacttacgaacaacgtaaggctttagttgaagctgttagatatgtcgatttagtaatccccgagacgaattgggaacaaaaaaggtctgatgttcatgagtatcatatagacacatttgtcatgggagatgactggcgagggaaatttgactttttatctgaagaaggtgtagaagtaatttacttagatagaactccagaaattagcacaacacagataaaaaaagatttacaaggataggacttgctccttaaaatgagacacaagaatgatacttagcaaactagagacaggagtgttttgtgggtatttgataattgtaaagaatagatgaaaagttaatacctagagaggacgaaattcgttctctctttctttatgttcaaagcaatcaaaatccgttttttaaagttttcaaagttcctgaaaccaaaggcatttctcttaatgactttgatgagattgttagtagcttccagtttggcgttggaataaggcaattctatggcgtttaaaaccttgtctttatcctttagaaatgtcttaaacaccgtctggaaaataggattaacggtggttatttcctattcgatgaggtcaaagaaatggtctgagttcttcttttggaaatgaaacaagagaaattgatagagttcatagtgctgtcggagttcatctgaaaaatacagtagttttctaggatttccttgttagtcaaatgcattcgaaacatagggcgataaaatcgtttatcattgattttacgactatcttgttgtatcagtttccagtagcgtttcaagaccttgtattcgtgggatttgctatcgaattggttcatgatttgaatgcgaacgcggttcatagcacggctaaggtgctgcacaatgtgaaagcgatcaaggacgattttggcatgcggaaaaagctgtttagccaaattggtagtatgggctaaacatgtccatagtgatgactttaacgcggtttctagcctgtatggaatagcgtaggaagtggtttctaatcgtggcttgcgtacgtccatcgaggatagtgatgacttttagcgagtcgaaatcctgagcgatgaaactcatttttcccttcttgaagccgtactcatcccatctcatattctcaggcaaccaattccagtcggttttaaattggaactcatttagcttgcgaataacggttgaggtagagacgacaaggcgcttagcgatagcggtcatagactgtttttcaatgagaagttgagcgattttctggtgaacgatgtttgcgatttggtggttcttcttgaccagagaagtttccgcgacagccatttttccgcactccttacacttgaaacggccctttttcaggagaatgagagttcggtagccagcacactctagataagggattttagaagctttctggaagtcgtatttgcccatctgtcccttgcaggcaggacatttaggaggctcgtaatccaagtaaccatgaacttctttgtgcgttcccatatcgtattcattagtgataataatatttttgtcttttattccgataaaatttgtgatactatttagttgttccatataacacctttctaatgatttggttgaacgcttttcattataggtcatatgggacttgttgatgctgtcgaaatactacatattgtggttagtgtaaatagatatatagtttggaaaaattttttagtaaatgtttttagggggtttatattatttatttatttcctactattctctctattattgctaaacttgatgaaggttgtattgtctgttataatattggatattgcaagctttaagtgaaaggttttagggaagagattatcacaactcattctttattggctatgagacgatggtataaatgatagtctagtaaaagatttggagaaatgacttccctagaaagttaaatgtaaaaacaatatgaaaaaatacgattatctagttgttggtgcaggtctgttcggagcggtctttgctcatgaggcagctaaaaagggtaaaaaaataaaggttatcgaaaaatgcaatgtcattaagttaagcatttaaacaattaaagaaactattcccgtctgagcagttgatgacaagacgggaatagtttttgtatttagggcacacaaaaaggaaggtttttaacccaattttttaactattatgatattctataagtgaagcttacgggagcctggctttttatctttctttggaaggttcgattgggtcggatgatggataaatgtttggcaatgtaggtttctaattggaaggaagtaagttcttctctaagaaattttcgacaggcataaacagcgtctgaaaaacaaattttataagtctgttttaactttgatgttttaatggtaacgtgtgaggttagccatttacaaacattaaagttgataaagcgagcgtagatttcttggagaatcccttccttctttttcgcacgaaaatgagtcaacccaatactgtattttaggtcacgaaaactggtctctatgccccatctgtaggcatagagatcttttaatttttctggtgaataattcgtatttgtcaccaaagtttcaaagaaacctggcttgatttcgagacgcaccattcggaaatgaagttcataaaactggagtggatcactttttcggctagagtttggtaaaaagtcaaaggatgtgtgattaggtaaacagcgatagtgattaggaaaattttgatactgttgtttcatctcattggtctgtttccgacagatgtttaggtcaaatttttcatcaaaacaaggggtgtcagggaggttaaatcctgacttcatagaatgattcccgtcacgaatacgaataatataggacttgacagtgtgccatgacattgtaggattcataccccctatccattatcacgagagcttgtttgaaagaagaggtcttcatcatgtcaataaaagctgctcgttcatcaagattcctattatcttggattcgtaaatcatgatacatctcttgttcaagattgtagagagcattgatatgaatgagattatggggagcgtggtgtggtccagtttgaaaagaggtcgttttatcagaacgatttcttggtagaatcacatcactaccatcaacagctaggatagggaggttgtgagatgttggaattttagaagtaatattggtaaacagggctttaaaagcttgatgtttgatctgatatcgtcgttggacaaaggcagattgggtaactggtaaatgtaagtcaagtaactctttagataaggtattgcctcccatggtaagtatagcttgaatcatggttttcatagttagctgacttttccgactaaaatcttttttaggatgaagtacaaactggtttgcggtggaaacgatgtcgttaatactatcaagtaaatgagctttaatctgatctagcatgacttttccccttttatttttagtgtaacataaaaactaacccaccacaaaatgtgataggttagttaacttaatgacattgatcgaaaaacgagaccacattgcaggtaacatctatacaaaagaagtagaaggtattcaagtccatgaatatggcgcacatattttccatacttctgaaaaagaaatttgggattatgtgaatcagtttgcggagttcaaccgctatacaaacacaccagttgccaactacaagggtgagatttacaatcttccattcaacatgaatactttcaataaactgtggggcgtggtgacccctgctgaagcagaagtgaagattgcagagcaacgagctgtattgggaggaaaaacacctgagaacttggaagagcaagccatctcactagttggtacagacatctatgaaaaattgatcaagtcctacaccgagaaacaatgggaaaaaccatgtacggagttaccagccttcatcatccgtcgtttgcccgtgcgtttgacttatgacaataactatttcaacgatagctaccaaggtattccaatcggtggttacacgcagattgttgaaaaaatgttggaacatgaaaatatcgatgtggagacaaatgttgatttctttgccaataaggaagactatttagcgacctatccgaagattgtctttacaggaatgattgatgaattctttgattaccaacttggtgaattggagtaccgtagccttcgatttgagacagaagtattggatatggaaaactatcaaggaaatgcggttgtcaactacacagatagtgaaacgccatatactcgtatcatcgaacacaaacattttgaatatcgatagtcttgtagatataaccatctcgaatcatgttttttataacgacagtcatgttgccagatgtacttaataatttatcaattaagtcttgaatccgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttttcatgagaatattttagcaataaatagtccggttatcaagcaaaaaaagttaaatcctatattcataggtaaagtactttctatagcatagaggagctgaactgtgggtcccagttcttatattcgttctctgtctgaaggagaatgaaaggttatttttgtttttccatcgttcaatcaggcgacggttatcaattgtcaaatgtttgccttttggtgtataatgtttttgcatctctgtgcctctttcttgtgtttgtggtgaacaacaagtatagcacagaggtgttttcttttaccttaaattggatttcatttgacaacaggaacccttgaaactgttttgtcagctaaaccaaggttactattagcattggctacttagtctaacagcttcaaacctgttatcaaatgaaattaccggcttactcaaagatagtgaaacaagtatttttgagcaaggcgaggtagctaactttattatagaactttcaaaatgtaatggagattgatttttcacaagtaattgtcataaaaatcagaaaatattttataaatatgataaaataaaagtgatactaatttgaggtaaggatatgaaattaagaagaagcgtagaaaaactaaagggaac

SEQ ID NO: 44 - DNA, 26179 bp, Streptococcus suis
atgtcaaaatggaaaattgttgcagattcgggctgtgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcgggttcggcgtgtccaagtccgcaggcttatcaggcagcttttgagggagctgagaacattatcgttgtgacgattacaggtgggctatcggggagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggactagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgttttctaagttcgaggggggattgtttgtatgagactattagatttcattcattcaaatatcttacgaattgctccagtttatctgcaaaatcttgttcaaagaagatctgtaagaaatcagctttctgtccactgaaataataacatttgccaaacatgtgttggatgctaggcgaaagaatccccttgcttagctgaaaggtcacgctccctttggaaattcgaaacgggatgttcaaagcgtatttctctaaacaatcttttattttattccactgagcgtgataaatatgatgaagatgctgtgtgttccgtgcaaacataccgttatcaatgtagagcgatagagctttttgcatgataagattggtatcgtagtcgattagactcttatgtttgatgaaggtatcacgtagctgattaggaaggctgattgcaccgattcggagggcgggaaagagtgtcggtgtaaaagattttatgtagatgacacgattatctgtatcaagatagtgtaaaggtaggctatgactagagtcgaaatccgccaaatagtcatcctcaatgatgtagacattgtattgctttgctaattttacgatggctgtttttgttgctatatcataagttgaaccgagagggttgtgcaagcgaggaattgtgtagaaaaacttaatttttccagtctggaagatactttccaattcttctaggtcaattccatctaaatctcgttcaattgtttgataggggattctttgatgtcgaatgagctctatcattcgtgaataggtagggttctctatcaagatttccgtttttccagccaaggtttccatttgtgtgagaatatatagggcttgttgactaccagctgtgataaccagatggtcattttttgtatagacatgatagtccattaacagactttgaacggaggaaattaattctgccaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttgttttggtattttaattccaacatagccttttggacagtgtctttgctacaatgatattgctcgctgagttgacggatagaaggtaatttctctccacgtttgaatcgatgttcctctattccagtcaaaatatcttggatgataacttgatattttttcatctaggcccccttttttatagactatgttactagctagtatataggaaaagttgcagaaagacaatatatgaatgatggggttgaggttcaggaattaagctactctatggtataattaagtgatgaaaataattatacctaatgcaaaagaagtaaatacaaatctagagaatgcctcgttttatcccctgtctgatcgaagtaagccggtgctggatgccataagtcaatttgatgtaaaaaagatggctgccttttataaattgaatgaagcaaaggctgagttagaagctgaccgttggcatcgaatcaggacaggtcaagcaaaaacctatccagcctggcagttatatgatggtctcatgtatcgttatatggataggcgaggtatagattcgaaagaagaaaattatctgcgtgaccatgttcgtatagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactagcttcgtcagaatttgagcaggtgttttctccacagattcagaaaagattagttaaaattcttttcatggaagaaaaagcaggtcagctaaaagttcattcgactatatcaaaaaaaggtagaggaagattgctgtcctggttggctaagaacaatattcaggaattatcggacattcaagattttaaggtggatggctttgaatattgtgcttccgaatcaacggcaaaccaacttaccttcatacgattaatcaaaatgtgaaataatgaacaagataacgttttctgatgtcgagcgtatctagaaaaatcttgatttctatggtataatgggtaagttataagtaaaaaggaaggttgtttatgaaaaagagaagcggacggagaaaatcgtctaagctcaagttgataaattttgcgctttggggactttatgccattactctatgtctattcttagtgaccatgtatcgctataatatcttagattttcggtatttaaactatattgtgacgcttttgctagtaggagtggcagtattggctggattattgatgtggcgtaagaaagcgcgcatatttacagcgctcttacttgttttttcactggtcatcacgtctgttggaatctatggaatgcaagaagttgtaaaattttcaacacgactaaattcaaattcgacattttcagaatatgaaatgagcatccttgtcccagcaaatagtgagattacagatgttcaacaggtcactaatgtacttgctccgactgaatacgatcaagacaacatcactgctttattaaatgatatttccaaaatggagtctactcaattaactacaagtccgacgacctcttatctaacagcctaccaagctatgctaaatggtgagagtcaagcaatgattttcaatggagtttttaccaatattttagaaaatgaggatccagacttctcttcaaaagtgaggaaaatatatagttttaaggtgactcagactgttgatacagctactaagcaggtgagtggagacagttttaatatctatattagtggcattgatacatatggcccaatttcgtctgtttcgcgttcagatgttaatattattatgactattaatcgagctacacataagattttattgacaactactccacgagattcttatgttgctatcgcagatggtgggcaaaatcaatacgacaaattaactcatgctggtatttatggtgtcaatgcctctgtgcataccttggaaaatctttatggtatcaatatcagtaattatatccgtctcaactttacatccttcctacagttgattgatttggttggaggtatcgatgtagaaaacacccaagagttcacaagtggtgagcatactttcccagtgggaacagtacacttaaatgcagagcaagcgctaatctttgttcgtgagcggtattcgttggctaatggtgataatgaccgtggtaaaaatcaagaaaaagtcattgcagcacttataaaaaaattgagctcaccagagaatttacgtaattatcgagctattttaaatagtttagaaggatctattcaaacggatataagtattgaaacaattataggcttagttaatacgcaattagaagccggcacacagtttaccgtggagtcacaagcactggctggaagtgggcgaacagacttaccctcttatgccatgccggattcacaactttatatgttagaaataaaccaagaaagtttggaacaagcaaaaactgctattcagtcagtattagatggaaattaaaaaataggagaaaacatgaataatcaagaaatgaatacaatagaaattgatattttattcttactgaaaacgatttggagaaggaaaatcgttatccttttgatggcactactaagtgcaggtttggctttcgcatatagtagttttttggtaacgccgcaatatgattcgacaactcgtatctatgtagttgggcaacatgctgaagctggcgcgggattgacaaatcaggatttacaagctgggtcttatttggtaaaagactataaggaaatcatcctatcacaagatgtactgacacaggtggctacagagttgaatttgaatggaaacctaaaagaaaaggtttcggtttctattcctgttgatactcgtattgtttctatctccgtgcgtgattcgaacccgaatgaggctgctcgcatcgcaaatagcctccgtagttttgcggcacaaaaaattatagaggtcacaaaagtgagcgatgttacaacactcgaggaggctgtcccagcagaggaaccatcaactcctaataccaaacgcaatatcttgcttggtttattagccggcagtatcttggcaacaggtctcgtgttgattatggaaattttggatgaccgtgtaaaacgtcctcaggatatcgaagaggtaatgggattgaccttacttggtgtagtgccagattcgaagaaattgaaataggagaaaaatatggcgacattagaaattgcacgtacgaagaaagaattagtaaataagacagaagaatattttaacgctatccgtacgaatattcaactcagtggggaagatattaaagtggttggcataacttctgtccaatcaaatgaaggaaagagtacaactgcagctagtcttgctattgcctatgctcgttctggctacaagacagtcctggttgatgccgatattcgaaactcagtgatgtcaggtttctttaagccaattacgaaaattacaggtttaactgattatttagcaggaacaaccgatttgtctcgggggctatgtgaaacaaatattccgaatttaacagttatcgagtctggtaaaatatctccaaacccaactgctcttttgcaaagtaagaattttgagaacttattagctactcttcgtcggtattttgactatgtgattgtagattgtccacctctagggatggtgattgatgcggcaattattgcccagaagtgtgatgcaatggttttagtagcagaggcaggacatgttaaacgttcagccgtgaaaaaagtaaaggaacagttggagcaaactggaacaccgttcttaggcgttatcttgaacaagtatgatattgcaactgagaaatatggtgattatggaaattatggtaactatggaaattacggtaaaaaagcttgatttttatgatatgagctttgattaagtaggtgttagtatgattgatattcattcgcatattatatttggtgtggatgatggtccaaagacaattgaagagagtctagatttgataggagaagcttatcgccagggggttcgcttcatagttgctacttctcatagacgaaaagggatgtttgaaactcctgagaaaattattatgactaattttgttcaagtaaaagagagagttaaagtagcttatccagaaatgactttatgttatggagcggaactttactatagtaaggatatcctaagtaaactcgaaaaaaaggaagtcccaactcttaatggaacgcgctatattctcctagaatttagtaagagtactccttggaaagaaattcaagaggctgtgaatgaagtaatgttacttggactaactccactacttgcccatatagagcgttatgatgctctggcatttcagtcagagcgagtagaagagttaatcgacaaggggtgttatactcaaattaatagcagccatgtgttaaaaccaggtttaattggtgaccgagcaaaagagtttaagaaacgggcacggtactttttagagcaggatttggtgcattgtgtggctagtgatatgcataatttatcaaatagacctccgtttatgagagaggcttataagtcaataacagaggaatttggggaagatagagcaaaagctttattgaaaaagaaccctcttatgttattaaaaaaccaggtgatttaagctggttactctagattttggagaaaaaaatggatttaggaactgttaccgataaactgttagagcgtaatagcaaaagattgatacttatatgcatggatacttttcttattgtagtttccatgaatttgagtagactgttcttggatattattattgacattccagataaacgtttcattcttgcagttttatttgtattgatgttttatctgattatttcagttaaattaaaggttttttcgttaattacgaggtataccggttatcagagttatataaaaatagggttgagcttggtatctgcttattcattatttttaattatctcaacgattttatggcagagttttagttatcgcttcatcttagtatccttatttttgtcatatgtattgctcattaccccaaggattgtttggaaagtcttgcacgagacacgaaaaaatgctattcgtaagacggatagctcactgcgaattttggtggtaggtgctggagatggcggaaatatttttatcaataccgtcgaagatcgaaaattgaattttgaaattgtcggcatagtcgatcgtgatccaaataaacttggaacatttatccgtaacaccaaagttttaggaaatcgcaatgatattccacgcttagtagaagaattggcagttgatcaggtaacgattgctatcccttctttaaatggtaaggagcgagagaagattgttgaaatctgtaatactacaggagtgactgtcaataatatgcctagtattgaagatattatggcgggaaacatgtctgttagtgcctttcaggaaattgacgtagcagatcttcttggtcgaccagaggttgttttggatcaggatgagttgaatcagtttttcaaagggaaaacaattcttgtcacaggagcaggcggctcgattggttcagagttatgtcgtcaaattgctaagtttacgcctcaacgattgttgttgcttggacatggggaaaattcaatttacctcattcatcgagagttactagagaaatatcgaggtaagattgagtttgtccctctcatcgcagatattcaagatagagagttgatttttagcataatgtctgagtatcaacctgatgttgtttatcatgctgcagcacataagcatgttcctttgatggaatataatccacatgaagcagtgaagaataatatttttggaacgaagaatgtggctgaggcggctaaaactgcaaaggttgccaaatttgttatggtttcaacagataaggctgttaatccgccaaatgtcatgggagcaactaagcgtgttgcagaaatgattgttacaggtttaaatgagccaggacagactcaatttgcggcagttcgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatctttgtcttggatatgggcgagccagtacaaatcctggaattggcaagaaaagttattttgctgagtggtcatactgaggaagaaatcgggattgtagaatctggaatcagaccaggcgagaaactctacgaagaattactatcaacagaagaacgtgtcagcgaacagattcatgaaaaaatatttgtaggtcgcgttacaaataagcagtcggacattgtcaattcatttatcaatggattactcaaaaaagatagaaatgaattaaaagataagttgattgaatttgcaaaacaagaataagaaagtaaaaaaaatatttttactttcctagagtttaaacgatgtttaggttctaggatggttgaaatacttaatgaatatagtattggagagttggttccaagatatttaaaatctagtaaatttgctttatattatataggagattatcggctttatagatatgaatgagttgataagaataaaattaaaaatggagatgaaaatgtatccaatttgtaaacgcattttagcaatcattatttcaggaagtgctattgttattctgagtccaatcttattattgattgcattggcaattaaattagattctagaggtccggtactatttaaacaaaaacgagttggtaagaataaaaaacacttcatgatttataaattccgctctatgtatgtagatgctccaagcgatatgccaacccatcttttgcagaatcctacagcgatgattacaaaagtaggagcttttctacgaaagactagtctcgatgaattacctcagctattcaatattttcaaaggagaaatggccattgttggtccacgtccagctctatggaatcaatacgatttgattgaggagcgagataaatatagagcaaatgacattcgtccaggtttgactggctgggctcaaataaatggccgtgatgagttagagattgatgaaaagtcaaaattagatggttactatgttgagaatatggggctgctgcttgatattaagtgtttttttggaacgtttattagtgtagcaaaaagtgaaggtgtcgtcgaaggtggaacagggcagaaagggaagtcatgaaaagagtattgataacaggagcaaactcatatattggaacttcgtttgaagaatacgtaaaaaataaggatagtaattttgaaattgatacccttgatttattagatccaaattgggaagagtttgatttttcaggctatgactccttgtttcatgtggctggaatcgcacatttttcaaaagatgaaagtcagaaacaactttactatgacgtcaatacagaattaacctataaagttgcctccaaagctaaactgtcggatgtacaacaatttatctttatgagcagcatcatcgtctatggtgatagttcaagttcggaaaggattattactagagaaacagttccaactccttctgatttttatggagacagtaagtggcaagcagaaaaaaaactgtcaggcttggccaatgatgactttaaaattgttatcgttcgtcctccgatgatttatggaaaaggatcgaagggaaattatcctaaactttcaaagttggctcagaaaacaccagtttttcctaaaatttcgaattctcgaagtatgctacatattgacaacctttgcgaatttatcctacaggctattgaaagaaaaatagaaggcgtctattttccacaaaattcagaatacgttaccacatctgacctggtaggtaagattgccgaggcacatcataaaaaaatctatttcaccaaattattcaatccaattattagactatttttcggattagatacggtgaagaaagtgtttggaaatcttgtttatgagaaagagatgagccgttatgactttgaatatcaggtaatcgactttgaggaatcaataaaaaatacagaattatgatagaacaaaaattaaaagggaaaagaatcttattcattgcacttcctggctattccaaaggtatgaaggaaaaaatggaagatatgggtgcggaggttatccatattaatgacaaaccgaaggatacttttctaggtaaggctctaggaagactaggtttgggtttctacgagaatattattaatgattactatgctgccgaattgtcaaaaattcgagaagaaaactttgactacatattagttattcgtggagagtacactcctaaagacagtttggaaaggatgcgttcctattttccaactgccaaaatggttctctatatgtgggatagcttagtaaataataaatttattcgtgcaaaatgggaatattatgataaagtttatacttttgataggatagactacctcaatcataaagaatcaattgattttttacccttattctattatgaggattacttgccaaaagatacaggcattatagaatataaatatgatatgtcctttattggaacaggccatgaagatcgggtaaagattataaaagcattaacacatcagttagaaaataagcaacgtaacgtattttcttattttttcattccacacaaattagtgtactacctcaataaaatcaaaaatcctcatttcaaatatgtacagatggaagatgtagaattcaagcaattaccatttgaaaaattatatgaaatatactctcaatccaagtgtgtagttgatattgaaagctcaaagcaaaatggactgaccatgaggacaattgaaatgattggtctggagaagaaactgataacgacaaataaagatattgttcattatgacttttacaatccggctaatataatgattctagataggaatgaccctgttattgatttagaattcatagacaaaccttatattccactagatgagaagataagaactaaatacagtttacacgattggatactaaatgtacttgaaataacctaaggaaaggtaagtaaaaatgataaaaaaagttttttggtttttgcgattagtgttcttaaagcctttctttaaatctgtaggaaaaaattcttatctaggaccaacagtggctacccatggtttaaagggagtctccattggcaatcgagtgagaatctatccaggagccagaatggaaactcataatggcggagaaataataatcggagataattgttcaattggacagaattttcatataatttctgatgaaaacagattgataattgggaaaaacactactatttcaagtaatgtttttattacaaatactgaacatgattacaaagaaattggagaacatattctgaagcaacgaatgctaacgagtgaaacgcagattggtgaaaattgttttattggttttggtgcttcaattcaagctggtacagtattgggcaaacaatgtatcgttggtacaaacgcagtggtacgtgggacttatccagactattcagtgatagtaggtgttccggccaaggctatcaagagatataatgaggagacaggagattgggaaaaaatatagagaaagcatctatctcagtgattattcctgcttataatgcagaaaaggtcataactagagcattagagtccgttaggttacaaactggcctagactatatcaatgagattattgtggttaatgatggctcgaaagatgcaactgcagcggaagttgaacgttatgcacaaaactatccagaccttactattcgtctaataaatcaagaaaatgcaggagtatctagagcgagaaatgtgggtatgcaaaatgcctcaggcacttggattgctctactagactctgatgatgaatggtttgagaataaaatagagagacaagtagctgaaattttgcaaaacgatgctatcgactttattggtggcaatcacacaccgttccccgttagcatattaggacgaaaaatagtgactctttataaagcaagtatccaagatatttgtattaaaatgttcccgcagacatcgactgttctattcaaaaagtcaatcttcgatgaaattggtggctatgatgagtctcgccattacgcagaagacggacagtattttttgaaaatttgtcatgcttatggctactattatttaccagagcagaatgtacattatgaccgtggaaaacgtggctttggtgtaagtggtttatctggaaatatcaaggggatgcaagagggaaatcgaataaattttaaagaattattagatcaaagaaaaataagtctcccgttctatattgctatcacaatttttaatgaattaaaatatgtgcgaagaattattttatcaatgagaagttgatggcttgtgcgttaaaagccattgctttattctaaggtcatttgttcgtaaccataagttagacatataggtgaataagtgaagttgataatgggacagcggtttgtttctacattaagaagtaaccaggggctaagtagggattactaaagatgaaattaaaaatattgatgtatgttaatagtttaaactattatggaggcatcgaacgtgtaattgcaaatttgtctaatgcactatcagaggactatcaaataacaatattggtaaaagattctccagtgtcagtttacagattaaatgagaccatttcgattcattctatcaatgagaaattagaattaaatatgaattcgaagttgcatagaatattgaatgtcccttataatatgatacgctcaatcattggtttgaagaaatatttcaaatcaaatgattttgactatgtttatacagcatttccaacaaatggcttggaagtatatttggctagtaaaaagtatagaaaaaaactagttgcctctgagcatgcttcttattatgcctataactcaatttataaaaaaataaaagaatatctatatccgaaattagcatttatatctgttcctacaaaaatggatacagaaatatataaaaaattaggttataatgctatttacataccgcatttaacgacctatggtaagaatgaaaacaattcgcttctagaaaaaacaatcataaatgttggccgtcttacatcagataagcaacaaatgatgttattggaaatttggcagattgtcaataagaagataccaaataatgagtggaaattacagattattggaagcggagaagaggaagacaatttacaaaactttatttcatcaaacgatataaagaatgttgaaatggtaccacatacctcgcgaatcgcagactattattctgctagttcattgtttgtattcacatctcgaatggagggatttggaatggtcttattggaggctatgtcttttggtctcccatgcatctcatttgattgccctagtggtcctagagatattattgatgatggtaaaaatggctttttaattccctgttatgataaggaattttttgctgagaagatttgccaatacataatgagtaacagtgatgacaagcaaaaactcggtcagggagcaactagaaaagtagaaaattgggacaatagagctatacttgaacaatggaaggatattttcaagtaaaccaaacgaaaaggagtaatatatgagaccgattgcattttatttgccacaatttcacgccattcctgaaaatgatgaatggtggggagaaggattcacagaatggacaaacatgaaggctgcaacaccattgtttgaaggtcatttgcaaccaagaattccattagataataattattataatttactagacgaaaagacaatggaatggcaagtagaacttgcaaagaaatatggtttatatggcttttgtttttaccactactggttcaatgggcatatgctattagaaaagcccatggaaatgatgttgaacaatcctaatattaattttccatatatgatttgttgggcaaatgagccttggacaaatgcttggaaagcggatgggaatgaaaaaactttgattgcccagcattatggaagagagaaggaatggaaacaacattttgagtatctattacaattcttcaaggataaaaactacatagttgaaaataataagccgatgttactaatttatcgtccagagattattgaatgtttgaatgaaatgctggattattggaatgaattagcgattgaagcaggtttctctggcattgattttgcctaccagcaagtttcatattatttgttggataataaagatgagagtcgatttaagtacagagttgaatatcaacctggttatgcccgatatgatgttcaaaagcaatcagcaggactgtctcagtaccttttaccaataaagacaaaaataagaaatattgtatatggatttgataaaaaagccaagactaatctgtctagtaaactaactagacaaaagttaagctttgaagactatgatgaattgtgccagtcaatcatcaatcgaaaagctgatgatgagaaatcagttgcaggaatgtttgtggattgggataatacacctcgtcgaggagatcgtggcagagtatgtttaggatcaacacctgaaaaattccaacattacatgattgaacaaattaagaacgtcaatgagaattaccagaacgatatgttattcatttttgcatggaatgaatgggcagaaggtgggtatttagagccagatgagagaaataaatatgggtatttggaggctctaaaagcggcattgatagagggagaaaaatagaatgaaagtgcttgtgactggagcaaatggctatttaggaagcggcgttgtaaaaaagcttttagatatgggagttaccgtaatagctacagatatagcaacaacgcatattgatagtagagcaagaatttatcaatgcaatctattcgaaatcgctaacccattcgaatattttgaggagccagaagtaattgtgcatatggcctggagagatggctttattcataattctattaatcatattttggatttacataaacattatgaatttttgctgaaaatgtgtgcaggtggagtccgtaaaatttcagttcttggaagtatgcatgagattggcttccatgagggaagtattgatgaggatacaccgacagatccgagaaccctatatggaatatcgaaggatacgttgagacaattaaccaagttaatgtgcgtagagcagaatacggaatatcaatggttacgaggctattacatagttggtactagcgataatggtgcatctatcttttctaaaatcattcaatcggaaaaagatggtaaagaaaaatttccatttacaaccggtcaaaatcaatttgattttatagattacgacatgttttgcgatctattgtctaaagtagttcttcaagatgatgtttgtggcgtaatcaacatttgctctggcaagccagaaagattgtcagatagaattgagacgtttttaaaagagaataatttaaatataaggttagaatacggagtgttccccgaaaggccaaatgaatcaaaagcgatttggggcaatgataaaaaattgaatttagcacttgaaagttattataggcgacaaaatgaatcttaaattactttggattgttacgatttgggcgataaatatttttgtaggttttcgtcaaaaagatatggattatgaattagttctattcaatcgaggaaaatttggtagactgaagttatctacagtgcttgcagccctactattaataacaatggtatggaatgcgattgcaacaattgacttgcccgacatggagaactatttttggttatatcaaggcctgataggtggtgtagaaactggatatagttttttaatggatttattccgtagccatcagtttacttttttacagtttcgagcaacaatattaattgtttcgtatgtgttgatttggttaggcctcgtaaaaataaaagcaaataaaaacttggtgctagccttatattttgtttttccctataattttgatgtcattcaatttcgtaatttttttgcagctgccatctttctatacgggcttactgattttatgcttgataacaaaaatggcacaattaaatttgccataactacatggggttcttccctctttcattcaatcagttatatttattttattctgctcttaacgcataagaagataacgaattttaaatttatgagacaattatttgttgccatttttgtctcgttgttactagtatccgttctctttagggatcaacttctaggtctattttcaagtatttttattggatttaatcgcgagaaagcaacctattacttgaatgagggaacaaggaatggatttttagttttttggtttttcgagatagttttcctatatatatcatatttgttacataaccagaataaaaaatttaactttctttctgagtttgactcaaaagttgtcgaaaaaatattctggattaatttgatactaacattcctatttcctataacaatgattaattttaatttttctaggatttttagaaatatattaatcatcaactatggtttaggtgcctatgtattactcatgcctaaaatcagggcacgacaagtcgcagcactgtgcttctgtgttgcatatttatttcaattcttatacaatcttcaaatttccccaaatttaacatttttaccatttttcaagtaaaaaggaatcattttttccaaacaagaataaaggagagttatgaaaatcgtattctgtctgcctaatattagtaagcagccatcaggtggttataagattgcattcgaatatgctaatcgtttgcaggaatatgggcatcaagtgagcatagtatttttaactcatacccagtattcgaggtatacatctagtatttttataaaaaatgctattggttctctctataattgtatttatccacgttggttcaagttacataaaaatattcaaagaatagctacagcttacattgatggtaggcactttcctgatgctgatattgttattgctacagctgttgaaacagcagaaatagtaaaaaatcttcctctgtcaaaaggaagaaagttttacctaatccaagactttgaaagttggcaatttagtgatgacgaggttttcgctacctatagatatggtatgaaaaatattaccgtttcgaactggttaaatgatctcgtgtcaaaagaatctgagaatacctatctgataaagaatccgattgatgtggaaatatttaaggtaaatcaggcaatcgaagaaagatcaccttttgagattgggatgttataccataaagcgccctataagggatgttcagttgctctagaagcgattcaattagctcgacaaaaatatcctcaaataaaactaagtttatttggaacgcctgctgagccagactttttggaagattggatgacctacacgcatcgagcaactgatattcagttacagcaaatctataataaggcttctatttttgtttgtgcgagcataaaggagggatttggtttgactggtgcagaaagtatggcttcaggctgtgcttttgcaagtacaaactatctaggtgttcatgaatatgcagttcatgataggaatgctcttttatcggaagtaaataatcctgaggaattggcgaataatataatgaagttgatagaggacgatgccttacgatatcgtcttgctaatcaagcagtttccgatcttcaggagttttcttggactaatgcgataacaaaaataaatcaattattcgaagaatcaatgtaagtaaaacttgtttctttaggattgaattttgggaattgtagataagagggaagttttgaaaaacacaatgacgaagcatgttgatctcaatcatatgcttcgttttcaagtagataatctcaggttaattcatctgatcctagtaaaaagagaagtgacaaaatcaaattgtcaatttatttacgattcctcattttcatcatttgataagcagcatcccaaagagagatgtagatggcaattgctggatgtttctccttgatagttgctatcaatcaacttaggtatatttatttctatgaaaacaataaaaaattatatatatagttccctataccaaatttttttggtgatagttcccttcctaacgattccgtatgtatcgagagttctaggggcagaattgattggaattaattcctatacaaatactataatgagttatttcgttctttttgccaatttaggaataactatctatgggaatagaaccatagcttattatcgcgaagatattaacaagcgtagccaaaaattttgggaaatcattattttaaaatttttagtttccgcaattgtctacggagtatttcttgtatttgtatatttttatccacagtatcagtttatatttatgcttcaatctattcaaataattgcaacagcctttgatatttcttggttgtttagtggactggaggatttcaagaagacggttgttagaaactttcttgtcaaaactctatccgtgttattgatttttctgtttgtaaagactgagaatgatttgaatagctacgtgctaataacagttctggcaacattagcaggaaatttaaccttatggacatacttaaagtcctacatcgttaaggtcccgttaaataccctaagacatggggagcattttcttccggtattttttcttttcgtaccacaagtagcatcaaccatatttgtctcattaaataaaattttgttagggacattgtctactatggaacaaaccggttattttgacaatgcggataggattgttagggtcctgcttgctctcgtgtcctctattagcgtggtgatttttccacaagttgcgaatgcatttaaaaataatgatagtcaaaaggtgacccaattaaccaaactcacttttgatgtagttaatattattatagtgcctatggtagtagggattatttcgataagtgatgttttttctgacttattttttggaccagagttccaaggtataaatattgttctctctatactggtattggaattactttttatgggctattcgtctgttttaggaagtcaatacctagttgctacaggacaatctagatatttaagcatagcagtcataggaggattaatttctagtggtattctttctgttttattaattccaagttatggagcggtgggagcagctatcgcatcggttgtaggagaagctaccattatgataattgaagtttattgcttaaaaaaacaaatcaattttataagtctatgtagcgatgttccaaaatattttctagctagtcttattatgtttgtggcaatctatttgtctggaggttttattagtcaagtctacctaaatttagtaataaggatattacttggtatcttagtgtatggtgtctctttgtatgtcttgagacctcagctactaaaggattccacatcaaagtttgcagagtttaagaaaccaaattctttgtagaataaaataaagaaactataataaggcatatgtattgagtaaccacctaataacgaagtatattgaaagaggctccaaagtcgtgtcgactctggaacctttttcgcctctttgtcaactgtagtgtaactgccctataacaaggtatattgaaaaacgttccacagtctgcttgactccggaacgttttttctatttgcacttattctgaatcctataaaaaataaaactggaggattttttatgtcacactccatcgtcccattgactgttccccaatctagacgcgttgagaagaaaggcagaaacgatattctgatgaaaattcgtctcggaaaagtggaagtcacattctttcactctatcaaccatgaagtaatggaaatgattttggataaggtgctgcactatgaccatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacactttgttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagcccagttgataaaagtagcgagataaggagtagatttcgcatagctttccgcttagaatggttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagttttttttatatgttggttgagaaaagtaagataggacctaatatcattggtcccaaagctataatactgattcaaatcagatttgtatgctcggatagtatgagaactaagtcgtctttgaatagcacaaaagtcaagatatctctggatagtgtcgtaattcataatataatctccttaatatatcgtaataaagttattatatacgataatttatcaatttactaatgataataaattgttatcggtagaggagaactatgaaaaatttgccggaaattgaattaaataatgatgaaaaactctttttatttgaaattgattctaggataaaagcattattactagagttgcctgaatcatatcataacagcctacaaattgtaagaggaagtcgttttcgccccctattaacatattatgggtatacgctatattctgatgagttaaatgaaactatttatcaatcagccacagcaatcgaattaattcataaggcttctattattattgacgatattattgatcaagataaaaaaaggcatggtatgccaactgttcatcaacaatattctctaaatgaagctttgataatatcagtatttttactaggaaagtgtatagaaatgctgtcagatattgatgattctactgttagattatttagtcagatgattattaagatgtgccaaggaacattgagtgaattaaatattaacaatgagacagctattgcagatattagaaaaattttggacaatcaaacttctcaagtaatacagaatagtttattgattggcatgaaatcctataatgaatctatcaataatcaatatttggaaatagtaggttataaattagggtatttgtttcaattgttgaatgattgtgaagtatattttaatcccgaattttcgataaaatataaaggaaatatgaattttgatattaacaagcagcgaaaaaatttatgttattcatatttagaacagtctcttaactataaagaaaaatccgaacttgatcgcggaaagtactctattctggataatttgttgaataaatataacatattggatttaataaaaaaagaaatttattgtattgaattagatatacagaataatttaaatattttaggagaaactatgaatgtgcaacgcttatcattctttattgattatgctataaatttagctaaaacaagggcaagtatcaaataaaaagaggctgggcaaaaagtcttaaaaatagaaaacagcttagaatcacattgccagaaacggtgattctaagctgtttttgattgataaaatttttataggagggggaattttttagttttgcccagtctcttttgttcagttattattgtgataaaaaagggattattacgttatacaggttgattatcactggaatataaccaagaggatttacgtattgcccgttgaataattcagggaaattaggtgtgtctctatataaattaaagagattgataaagtctttatttaattgtgattgttgattcgggctattgtcatattctaaaagtctatttctctttattttttttataataatcttgatataagttttccatagataatcaaacaatatataacccaaaccaattaatatagcgataattccccatgttattatgaatacaatatcattagacgtatttatatttagtttattatttgaaaatgatatagcagataaaggagttgttaaataaaataataaagtataagcaatcccaaggacaccaaagtaattaccaaaagtgctcattgtgtctgtgaatttaacaatccaagtagcctcagatggattatgaagagaaattggagtaaatgtagtaaattctagatttgcaatttttcttaaagtaagaatgtaaaatatgtactttaagtatagttgtattgcaataaaaactgtaaagattaaagtaatactaccgtatactgtaataacttggttccacattaatacttttagcaaaatcaatgaaatgatatagataattccaattgctatagaaataatgatactgtaccatttttgtagataagttccaaatctgttacatatcgaaaatagcgaatatccatcaatagtaatgcctgaaatagacaatgaaagtagctcctctttcctcattaggcaatgatacgttacaatctgtgcaaatagcaaaagatttacaccgagtacgtatacatagttattcttcagcgaagagtcaaaaattgatagaattattccaaaaaaaatccagcatgtaaaaataacaccccatagacatttttttgaaagaattttatcaacaatccatatattcatagcattctcctaccgataacaatttattatcattagtataccataatctacatttgttttatagattttattaaaatttttatagtaaatatttttagtttttcgttctctaaaatgtaacaggaaatgtaatggagattgatttttcacaagtaattgtcataaaaatcagaaaatattttataaatatgataaaatgaaagtgatactagtttgaggtaaggatatgaaattaagaagaagcgtagaaaaactaaagggaacgattcgtgtcccaggagataaatcaattagtcatcgctctattatttttggttcccttgcaaaaggtgttactcgtgtccacgatattttgcgtggggaagatgtcttgtcaaccatgcaggtctttcgtgatttgggtgtaaaaattgaagacaacggtgacattgttgaagtacacggtgttggttttgatggtcttcaagcaccaaaaaatgatttggatatgggaaattctggaacctcgattcgtttgatttcaggcgttttggcaggtcaagactttgaggcgactatgtttggtgatgattccttgtccaaacgtcctatggaccgagtaactattccactcagtcaaatgggagtagagatttctggacaaactgaacgtgacctacctccgttgaccatcaaagggaataagaatttaaaaccaattcgctaccaattgcctgtagcctctgcccaagtaaaatcagctctgatttttgctgccttgcaggctgagggagagtcggttatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgccttttggttggttgctggcttaatcgtaccaggttcaaaaattatccttgaaaatgtgggaatcaatgaaactcggactggtattctagatgtcattaaagctatgggcggaaaaatgactctttctaacatagatgaacttgcaaaatctgctaccattacagttgaaacgtcggaattgaaggctacggagattgcaggcgaattgattcctcgtttgattgatgagttgccaattattaccttactagcgacacaagcacatggaacaacgattattcgtgatgctgaggagttgaaagttaaagaaacagatcgtattcaggttgttgcagatgctctaaatagtatgggagcaactattgaaccaacagaagatggtatgattattcatggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcaatcttgaaggagaggcttcatttagacaactggagacagaggtgttgaaagaattgctggacttacctagtaattgtatcgtgtcaactggtggtggtgtgattaaatctgaagtaaacagggaattgctgttggcaaatagggaggacaatgtactccttactgcctcctttgaagtttcctatcagagaattcgtaaggatagacaatcgcaaagacctctctttttacagtacagtaaggaagagtttgaagccctctatcgtgaacgaatggcactttatcaaggtttagccgatactgtaatcgatacagataaactgaatccagaacaagtagcaaggaaaattttatgcaagtagcctatctaggacctcgtggttcttttacacatcaagtggcccagcaggcctttccgactgcggatttgcaggcttttgagacgattacagaggttatcaaggcctacgaaacgggagaagttacctattccgttattccagtagagaactcgattgaaggtagtgttcatgaaacgattgactatctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagctagtacagcctatgctgctcgctttgtggcagaacaccctgaacaaccattcgcggcaattgctccgcaagcggcagcagttgaatatggactggaagtaattgcgcaagacatccaggaaatcagcgagaattttacacgtttttggattttgggggataaagttccgtctattgccctggaacaagtagctaaaaaagtcagtcttgcactgacattgccagataacctgccaggagccttgtataaggccatgtctgttttctcatggagaggaatcagcttaacaaaaatagaaagccggcccctgaaaacggctttgggtgagtattttttcatactggatcttgacaatcagtctgaggaattattagcctattctcaaaaagaattgacta

SEQ ID NO: 45 - DNA, 32134 bp, Streptococcus suis
tgattccttagtcagttgatttgcttctttatttgattgatagaggtttttcaaagattggggtgaaattttacgacctgccatagttttcctttttcgagtgtcacatctgaaagaaaatgctttcagatagggtagtttaatgatataattgtaagtaaatagagatttattgtcaaataaaaaagtaaaattggaaatgagaatattatgacaaaatggaaaatcgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcgggttcggcgtgtccaagtccgcaggcttatcaggcagcttttgagggagctgagaacattatcgttgtgacgattacaggtgggctatcggggagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggactagattttccacaagtagtagaagcaataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgttttctaagttcgaggggggattgtttgtatgagactattagatttcattcattcaaatatcttacgaattgctccagtttatctgcaaaatcttgttcaaagaagatctgtaagaaatcagctttctgtccgctgaaataataacatttgccaaacatgtgttggatgctaggcgaaagaatccccttgcttagctgaaaggtcacgctccctttggaaattcgataggggatgttcaaagcgtatttctctaaagaatcttttattttattccactgagcgtgataaatatgatgaagatgctgtgtgttccgtgcaaacataccgttatcaatatagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatatagatgacatgattatctgtatcaagatagtgtaaaggtaggctatgactagagtcgaaatctgctaaatagtcatcctcaatgatgtagacatcgtattgctttgctaattttacgatggctgtttttgttgctatatcataagttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcgatgttcctctattccagccaaaatatcttggatgataacttgatattttttcatctaggcccccttttttatagactatgttactagctagtatataggaaaagttgcagaaagacaatatatgaatgatggggttgaggttcaggttcaggaattaagctactatatggtataattaagtgatgaaaataattatacctaatgcaaaagaagtaaatacaaatctagagaatgcctcgttttatcccttgtctgatcgaagcaagcaggtgctggatgccataagtcaatttgatgtaaaaaagctggctgccttctataagttgaatgaagtaaaggctgagttagaagctgaccgttggtatcgaatcaggacaggtcaagcaaaaacctatccagcctggcagttatatgatggtctcatgtatcgttatatggataggcgagatatagattcgaaagaagaaaaatacctacgtgaccatgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcaactatatcaaaaaaaggcagaggaagattgctgtcctggttggctaagaacaatattcagaaattatcggacattcaagattttaaggtggatggctttgaatattgtgcttccgaatcaacggcaaaccaacttaccttcatacgatcaatcaaaatgtgaaattatgaacaagataacgttttctgatgtcaagcgtatctagaaaaatcttgatttctatggtataatgggtaagttataagtaaaaaggaaggttgtttatgaaaaagagaagcggacggagaaaatcgtctaagcttaagttggtaaattttgcgctttgggtgttatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcactggtcatcacttctgtcggaatctatggaatgcaagaagttgttaagttttcgacacgactaaattcaaattcgacattttcagaatatgaaatgagcatcctcgtcccagcaaatagtgatattacagatgttcaacaggtcactaatgtacttgctccggctgaatacgatcaagacaacatcactgctttattaaatgatatttccaaaatggagtctactcaattaactacaagtccgacgacctcttatctaacagcctaccaagctatgctaaatggtgagagtcaagcaatgattttcaatggagtttttaccaatattttagaaaatgaggatccagacttctcttcaaaagtgaggaaaatatatagtttcaaagtgactcagactgttgatacagctactaagcaggtgagtggagacagttttaatatctatattagcggcattgatacatatggcccaatttcgtctgtttcgcgttcagatgttaatattattatgactattaatcgtgctacacataagattttattgacaactactccacgagattcttatgttgctatcgcagatggtgggcaaaatcaatacgacaaattaactcatgctggtatttatggtgtcaatgcctctgtgcataccttggaaaatctttatggtatcaatatcagtaattatatccgtctcaactttacatccttcctacagttgattgatttggttggaggtatcgatgtagaaaacacccaagagttcacaagtggtgaacacactttcccagtgggaacagtacacttaaatgcagagcaagcgctaatctttgttcgtgagcggtattcgttggctaatggtgataatgaccgtggtaaaaaccaagaaaaagtcattgcagcacttataaaaaaattgagctcaccagagaatttacgtaattatcaagctattttaaatagtttagaaggatctattcaaacggatctaagtattgaaacaattataggcttagttaatacgcaattagaagctggcacacaatttacagtggagtcacaagcgctagttggaaatggtcgaacagacttgccttcttatgccatgccggattcacaactttatatgttggaaataaaccaagaaagtttggaacaaacaaaggctgctattcagtcagtattggatggaaattaaaaaatagggagaaaacatgaataatcaagaaatgaatacaatcgaaattgatattttactcttactgaaaacgatttggagaaaaaaaatcattatccttctgctgggactattaggtgcagggttagcttttgcttatagtagttttttggtaacgccgcaatatgattcgacaactcgtatctatgtagttgggcaacatgctgaagctggcgcgggattgacaaatcaggatttacaagctggatcttatttggtaaaagactataaggaaatcatcctatcacaagatgtactgacacaggtggctacagagttgaatttgaatgggaacctaaaagaaaaggtttcggtttctattcctgttgatactcgtattgtttctatctccgtgcgtgattcgaacccgaatgaggctgctcgcatcgcaaatagcctccgtagttttgcggcacaaaaaattatagaggtcacaaaagtgagcgatgttacaacactcgaggaggctgtcccagcagaggagccatcaactcctaataccaaacgcaatatcttgcttggtttattagccggcagtgtcttggcaacaggtctcgtgttggttatggaaattttagatgaccgtgtaaaacgtcctcaggatatcgaagaggtaatgggattgacattgctaggtgtagtgccagattcgaagaaattgaaataggagaaaaatatggcgacattagaaattgcacgtacgaagaaagaattagtaaataagacagaagaatattttaacgctatccgtacgaatattcaactcagtggggaagatattaaagtggttggcataacttctgtccaatcaaatgaaggaaagagtacaactgcagctagtcttgctattgcctatgctcgttctggctacaagacagtcctggttgatgccgatattcgaaactcagtgatgtcaggtttctttaagccaattacgaaaattacaggtttaactgattatttagcaggaacaaccgatttgtctcgggggctatgtgaaacaaatattccgaatttaacagttatcgagtctggtaaaatatctccaaacccaactgcccttttgcaaagtaagaattttgagaacttattagctactcttcgtcggtattttgactatgtgattgtagattgtccacctctagggatggtgattgatgcggcaattattgcccagaagtgtgatgcaatggttttagtagcagaggcaggacatgttaaacgttcagccgtgaaaaaagtaaaggaacagttggagcaaactggaacaccgttcttaggcgttatcttgaacaagtatgatgttgcaactgagaaatatggtgattatggaaattatggtaactatggaaattacggtaaaaaagcttgatttttatgatatgagctttgattaagtaggtgttagtatgattgatattcattcgcatattatatttggtgtggatgatggtccaaagacaattgaagagagtctagatttgataggagaagcttatcgccagggggttcgcttcatagttgctacttctcatagacgaaaagggatgtttgaaactcctgagaaaattattatgactaattttgttcaagtaaaagagagagttaaagtagcttatccagaaatgactttatgttatggagcggaactttactatagtaaggatatcctaagtaaactcgaaaaaaaggaagttccaactcttaatggaacgcgctatattctcctagaatttagtaagaatactccttggaaagaaatccaagaggctgtgaatgaagtaatgttacttggactgactccactacttgcccatatagagcgttatgatgctctggcatttcagtcagagcgggtagaagagttaatcgacaaggggtgttatactcaaattaatagcaaccatgtgttaaaaccaggtttaattggtgaccgagcaaaagagtttaagaaacgggcacggtgctttttagagcaggatttggtgcactgtgtggctagtgatatgcataatttgatagcccgacctccttttatgagagaggcttataagttaataacagaggaatttggggaagatagagcaaaagctttattgaaaaagaaccctcttatgttattaaaaaaccaggtgatttaagctggttactctagattttggagaaaaaaatggatttaggaactgttaccgataaactgttagagcgcaatagcaaaagattgatacttatatgcatggatacttttcttattgtagtttccatgaatttgagtagactgttcttggatattattattgacattccagataaacgtttcattcttgcagttttatttgtattgatattctatctgattatttcagttagattaaagattttttcgttaattacgaggtataccggttatcagagttatgtaaaaatagggttgagcttgatatctacttattcattatttttaattatctcaacgattttatggcagagttttagttatcgcttcatcttagtatccttatttttgtcatatgtattgctcattaccccaaggattgtttggaaagtcttgcatgagacacgaaaaaatgctattcgtaagacggatagctcactgcgaattttggtggtaggtgctggagatggcggaaatatttttatcaataccgtcgaagatcgaaaattgaattttgaaattgtcggcatagtcgatcgtgatccaaataaacttggaacatttatccgtaacaccaaagttttagggaatcgcaatgatattccacgcttagtagaagaattggcagttgatcaagtaacgatcgctatcccttctttaaatggtaaggagcgagagaagattgttgaaatctgtaatactacaggagtgactgtcaataatatgcctagtattgaagatattatggcgggaaacatgtctgttagtgcctttcaggaaattgacgtagcagatcttcttggtcgaccagaggttgttttggatcaggatgagttgaatcagtttttcaaagggaaaacaattcttgtcacaggagcaggcggctcgattggttcagagttatgtcgtcaaattgctaagtttacgcctcaacgattgttgttgcttggacatggggaaaattcaatttacctcattcatcgagagttactagagaaatatcgaggtaagattgagtttgtccctctcatcgcagatattcaagatagagagttgatttttagcataatgtctgagtatcaacctgatgttgtttatcatgctgcagcacataagcatgttcctttgatggaatataatccacatgaagcagtgaagaataatatttttggaacgaagaatgtggctgaggcggctaaaactgcaaaggttgccaaatttgttatggtttcaacagataaggctgttaatccgccaaatgtcatgggagcgactaagcgtgttgcagaaatgattgttacaggtttaaatgagccaggacagactcaatttgcggcagttcgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggacatttggcaaaaggtggagaaatctttgtcttggatatgggcgagccagtacaaatcctggaattggcaagaaaagttattttgctgagtggtcatactgaggaagaaatcgggattgtagaatctggaatcagaccaggcgagaaactctacgaagaattactatcaacagaagaacgtgtcagcgaacagattcatgaaaaaatatttgtaggtcgcgttacaaataagcagtcggacattgtcaattcatttatcaatggattactcaaaaaagatagaaatgaattaaaagataagttgattgaatttgcaaaacaagaataagaaagtaaaaaaatatttttactttcctagagtttaaacgatgtttaggttctaggatggttgaaatacttaatgaatatagtattggagagttggttccaagatatttaaaatctagtaaatttgctttatattatataggagattatcggctttatagatatgaatgagttgataagaataaaattaaaaatggagatgaaaatgtatccaatttgtaaacgcattttagcaatcattatttcaggaagtgctattgttattctgagtccaatcttattattgattgcattggcaattaaattagattctagaggtccggtactatttaaacaaaaacgagttggtaagaataaaaaacacttcatgatttataaattccgctctatgtatgtagatgctccaagcgatatgccaacccatcttttgcaggatcctacagcgatgattacaaaagtaggagcttttctacgaaagactagtctcgatgaattacctcagctattcaatattttcaaaggagaaatggccattgttggtccacgtccagccctatggaatcaatacgatttgattgaggagcgagataaatatagagcaaatgacattcgtccaggtctgactggttgggctcaaattaatggccgtgatgagttagagattgatgaaaagtcaaaattagatggctactatgttgagaatatggggcttctgcttgatattaagtgtttttttggaacgtttattagtgtagcaaaaagtgaaggtgtcgtcgaaggcggaacggggcagaaagggaagtcatgaaaagagtattgataacaggagcaaactcatatattggaacttcgtttgaagaatacgtaaaaaataaggatagtaattttgaaattgatacccttgatttattagatccaaattgggaagagtttgatttttcaggctatgactctatttttcatgttgccgcaattgtacacaagcgtgagaaaaaaatttcatatgaggagtataagaaagtaaatactgatttaccagttttgattgcaaaaaaagcaaaaaaagcaggagtttctcaatttattttcttaagtaccatgagtgtgtatggtctcaatactggtaaaatagcaagttcaaccctggcaattccaacgacgaaatatggtcaatctaagtaccaggctgaagaggaattactcaagttacgtgactgccagtttaaattggttattgtgagaccacctatagtttatgggaaaggttctaagggaaattattcgattttatcaaagttaactcagttaacaccaatttttccaaaaattttaaattctagaagtatgttgcatattgataacctctgtgaatttatcaggaaagttatagagttagagttgcgtgggctgttttgtccacaaaattcagaatatgtcaatacttctgaattggttaaagtaatagctgaagtacatagaaagaaaatatattttacaaaaatatttaatccagtcataaagttattgttccattttgatacagtgaagaaagtatttggaaatcttgtttatgaaaaagagatgagtcgttatgactttgaatatcaggtaatcaattttgaggaatcaataaaaaatacagaattatgatagaacaaaaattaaaggataaaagaattaaacggactcaagttgtaagtaaattgttttattgcatttaatgttttgcatcacgcagaaactttaacagaaaaaatgtgtagtagtataaatttggtttaagtaatgtttataaagattattgaatgatatcgggtattctcacagaactgattaaaaagatacaataaggagacagagttttgggaaaaaatatagaaaaatcatctatctcagtggttattccagcctataattctgagaatgttatagtaagagcgttagaatcagtgaggctacaaacttgtttggagtatattaacgaaattattgtagttaacgatggttctacagattcgacagcattcgaggttgaacattatgcaaaaaaatatccatatcttaacattcgcctaataaatcaagaaaatgcaggagtttctagagcaagaaatgtaggaatgttaaatgctttaggaacttggattgctttgctagattctgatgacgagtggtttgcgaataaaattgaaaggcaaattgatgaaattttagtaaatgatagtattgattttattggtggtaatcatactacctttccattaactattcttggacgcaagatagatagacttcatagagcaaatattcaagaaatttgtatcaagatgtttccacagacttcaacagtgctttttaaaaaatcaatctttgatgaaattggtggatatgatgagaaacgccattattctgaggatagacaatactttttgagaatttgtcatgcatatggatattattatttacccgaacagaatgttcactatgatcgtggaaagcgaggttttggggagcgaggtctatcaggtaacttaaaaggtatgcaagaagggaacagattgaatttcatggaattattaaagcagaaaaaaataagtttacccttttatattgcaatcactatttttgatgaattaaaatatttaagaaggatacttgtatcaatgaaaaaataataaatgtgtaccataaaaaacatacttgttcctattgctggtttatttctataaaaaatgtatggcgtaaactcaaagtaactatgaaattagaaatgaatatcttaataagtgtttggttcccaagagtataagaaatacccgaatattctcttttaagagaaaacatatcagaagtggctaagattggttataatgcaagtgaaaaaatctactactgttgactcagatattaagttctattcgtgattttaaatatttctcgttgtaataccacgcctctatttacaatgctataataaatcttttaaagggataacggtagaattaatggtttgtgatgctgtaaccttcatgtaccgaaatttagtgttgaaggcctgtcgacacttactaaataatcaaaatggattcggagttaacccgaactattgtttcattttgtagggagtgcgagaataagtttctttaataactatagaagtaaattaagtagttaagtatattttaaaacgcagtattgatttagtgatattcctgcgtacctttgggagataatttttttccgttttagaaaaatgagtgttagtatgggtatgtattgaataagatctaaattgttagtaggtgtcaaaacttaagttatccgataggattgattgggtctgtttctcgtctcaacacatgtatgattttaattatcagatagataattttaaaaaaagtcattcgattaaagaaagaaagaagtatttagtatgaaaaaagctcttattgtagcctctgttgcttcaatgattggacaatttaatatttccaatataaaaatattacagtcacttggttttgaggttgatgtagcagccaatttttctcattcaggtacaatttctattgagagtgtacaagaattaaaagaatttttagaggcaaataaagtcaacgtatatgatattccctttcaaagaaatccgtttcaccctggtaattggctcgcatttagaatgttgaatagagtgatgtctgataatacctatgatttagttcatagccatactccaatcggagggctaatagggcgtatcttaggttactgtcacaaagtggacaataatatgtataccgctcatggttttcatttttataaaggcggaagtagagtagggtggcttcttttttaccctgtagaaaaaatattatcttactttacagatactattattactatcaatgaagaggactatgctattgctaagaagcgtttcaaaatgaaggggttgcacttggtgaatggtgtaggagtaaatttagagaagttctcaccaatatcagataatacaaaggctcaactaaagttagtattgggtttagaccagaataaaaagtacctaatttttgtcggagaattgaatgccaataaaaatcaatctattttaattgaaatgatggaacaactttcaaaaacaagaaaggatattgttctattgctggttggtaaaggagtattattgaatacttatcgccaactcataaaggataaaagtttagaagaatcagtgcttctgttaggttatagaaaagatattcctgatttgatgagagtttctgatattgccctatctagttctaaacgtgaaggccttcctgtaaatttacttgaagcaatggcaactggactacctttaatagtatcgaattgtcgtggaaatagagatttagtagaggatggaaaaaatgggtatattgcagaaaactcagcagtagatgagtttattgtagctataacaagaatccttgatgatgcagttttatataagcaactttctcaatgttcacttatatctagtgaaaaatattctttagagcgagttgaagtaaaaatgaaggaaatttacagcaactccttttaggcaggttgctactttatagtgaaccatttgagttttcctgaaaaattatagaatcccttgttggagaatcaggacaggtgatatattcagtaggtgtaaagtaaagttaacaacaaacaatgttactaatctcaaatcgttatttcctaagttagggaagcgtatgtagactttgtaaatttcaataaattttctagtgacaggattcaatagaaaaataatcaacagaaagagtattagaatgttagttatttctaaaaaaaactttatgactgtggcatttggagctatagtcgtcatgttatatgcatttttcctattttttacaagctcctcttttgaggaagattttacaataaaatttagcattctcagtagtttaataatttttattcttgaaatcgtctatataaacaaattaaatgggggagttataaatcctattactctgtttttaatggcattttatgtttttcaaaatggacaactacttctggtagctctagatatcccattctatgatttctatattagtacgttaaaaatttttttgaaagatgtgtctattttttcgtcccttagcaatgtagtggcaggctatgctgggattatttgtgtttccatactacaaaaagagaaacactatgttattgatcagtacaatcctctagaagttggtagggtagcatggttgggttttttgggaacttcaattttagctctacctcttgttgcaatgaaatttcttacaagtttagaaggggggtattatgctgttagggcttttgaagagaacattccaacgctagtaacctttttagagtttatgttcatgccattttccctcttaacaattatcttcagaagcgataagagttcacaagtagcacgctacggtgtatttatctggttagttctcactgctctttgtggcgataggacaacaggtatttcaggattgcttattttagctcttgtttcatacaacaaaaatagtgggaatattaaatataattggaaagatatatctaagattagcttcattggtctattgctgattatctttatccgagtagtatatgcatatagaacaggagaagatatcctatttgccttatcaggcggaaacttcttggtaggctttttatctgagttaggaattagtgtttttccactatttacgatgatgtatattgttccagggcaagaagcttttttatgggggcaaggatatattttgtctgctattggcggtttgataccttcttttttagatattacaggtattgtaaatgtaataaatcagcaatctaggatatttgaaacttggcactctcaatatttttggcaatattcattcggtttaggtttttcccttaacgcagaggcctatatcaattttggttggtttggtttaattgctatttttatcgtttgtcttataattttttcgtttttacgagtcaaaaatttgaaagaacatactagcccatgggaactgtacaggataagtatcttgttgtttttatggtttacattaccacgtagagattcatactatatttggaaggcaatatcttattctttgatttttattagaatatatatacaaaccacatgtcgcagaactgcatttttaggtaaaacaggtagtaaggtggaattaagaaagtgagtgtagagtcaaatcaagttacatcggcagttaagtggtcgttagtgacagaaattattgttaagtttatttcgccaatcaccaatatgattctggcgagacttttaacaccagaaatatttggccttgtcgcgtcaattatgatgattactacgtttgctgagatgtttacagatgcgggtttccaaaaatatattgtacagcatcaatttgtttcttcctcagaacaagatgagtatatcagtgtagccttttggacaaatctgggtgtctcgatatttttttatcttttaatatttctaaatgcagaaacacttgctaacctcagtggtgtatctggttatgagacggtgattagagtctattccttagtattgcctctgatgtcctattctagtattcaatatgcagtatatagaaagaattttcactataaaaagctcgggattattagagttattgctaagctcatccctgtacttgtgacgatacctttagcactatacacccaatcttattggtcgttggtcattggaaacctggtgggggagttagtgattaccgttattctaataatatggtccacgcaacgcataaaacttcactatgattatgagcaactgaagagcatgtttatgttttgcggagggtcaatgttggagactctttcatcatggttagtttcgaatgttgcagtttttattattagccaatcattaggcgcgtattatctaggtttgtataagatttcaattacgactgtaaatcaaatcatttcgattattactgcttcaactatgaatgtgctatttgcgacactatctaaagtacaaaatgactcggactcttttaaccgaacagtaaataattttcaaaagtctattggtttatttactattcctttaggggtaggtatctttatttttcgtaagtttattacgctaacactacttggaccacaatgggaggaagcctcactctttgtcggcttatggggatttgtcatgtgcgagagcgtcatatttgcggatataggagcctatgcaattctttccaaggggaaaccaggatatgtatttttatctaatatattgcaagccctgctacttgcaacgggtttgttatattttgagcatagtagttttatggttataacctatgtttcttttgtaataagatggcagttgacagttacgcattattggatagcgtcaaaagttgcaaattttaggctcaaagattatccaaaagaattaaatgtatatgttggtgcagcaagtataatgggatgtttaggactactttttcaaaatataattgaaaaaaatattttctttaacattgttggggttcttatctgtattatagtctattttggagttttgatgatatttaacaacacaagaatagagttactatcgctattcaatacagtaagaaggcaattagctcgtaaataatgtttatttgtagattttaattatgctttagttaggatatagtagaatgaaaataataacttgcgcaagtttttatggtagcggctcaagtgcattgacagacttggttgcggagtactcctgtgtgaaggatttgacgaattatgagtttcgctttttatatgatattgatggtgtttctgatttagaacattatttatgtgaatgccatgacaggcacaatgcaggtcatgctctaaagcgctttaagagattatcggaattcaatgccggtacctttttcaatgcaaggtacgagccttttttcaacaatcaatacatgaagttgactagaaagttcattgattctataattgatttttcatatcctggctggtggttctatgatgtatatgacaaaggaaaagtactgtattatatattgattcaatgggataagatattacgaaaattaacaaatgggaaaaagagtattctatcccgagaacgaatattttgttcgcacccttcgcaggaaaagttcattgaatctgttcagaactatgttgcttcgttaatgcaggcggctaatccagaaggactgccattcttagaggttgatcagttggttccatctcagaatctcaatcgaattcttcgttacttttctgatgatatcaccgttttcattgtagaccgcgatccaagagatgtttacacaagcaaccgcttctactggaaagagaatatttgtccaacggatgatgtaaatactttctgcgactggtttctatacacgcgtaaaagtgggaaagtagaaagttataatactaatcaggtcattaaattacgttttgaagatatgatttataaatatgatgaaacagttgcgaagattgagatgctaactggtctggatagttcactacacagtatgcaattcaaaaaatttaatccacaacaatcagttaataatactcagatttggaaaaaacataacattgaagtagagattaaagttattgaagaaaggttagctgaatatttatatccctttgatgaagtgaacagtgatgccgttccaggagtaaaacaagaaggtgggaaaatattctgatagccatgactaaatatcttttaaatatttagaggaagccattgctggtttagcatggaataaatcgaaataaggggtataacttttagtgccccctccataaagattagaaggaatacgttataaatatgaaaaaaatctgtttttcatttaatcatttgacttattcagacggtgtggcccaatcagctattgcaatggcaaactatttagctgatactgaaatggttgaagtgacgctgagacctatttttaattttgacaagagtattttaaaagatataaacaaaaaggttaaagtaaaaccgattttgggtttttattttagaggcttgtcgacaattttaaatctagttccagcatttctattacatgattggattttcgggcgtgataggtatcaaatagagattggctttcaatatggtttggctacatgtgcggttgtatcatcaaatagtgtgaagtcaaaacactatgtatggatgcatggttatgatgaggggctacatcttaaagaatattataaaaaagccgatagagtagtttgtgtatcaaagcaaaatgcagatagactctttaaggaattacaatgtgcagtgcctgtggagtattgctacaatcctatcgataataatgtggtatgtaaacttggagaagaaaaaatagacttggcaattccgaaggaattactttttatctctgttggaagacattctgaagaaaagggttacttacgattgttgaagattgtagaacgtttaatgaatgaaggttacacatttaaattatggctaattggagatggaccacaacatggtgaattagtgaaatattcgcaagagcatggactggagaaggtggtagtatttatgggagcgcagaagaacccacataaatttacctcaaaagcagatttatttgtatgctcctcatatgcagaaggttttagcaccgcttgttcagaggctataatgttaggggttcctgtcctgacgacctccgtgagtggtggaaaagagattattgatactgcaaaaagcggtatgttagttggaatgaatgacgaagacctatatgagggcatgaagtacgttattgaaaatcaaaaacaggttgaagaatggaaagagaggctagtacatacaaaacataaattttctgcttctgagagaatttctaggttacttgctgtcttggaattatcgaaaaatgggtaaagatggatgcttagaggtcccctttatttggcggtcgttattgataaaattttagtcaggagttcataatctattttatagtttttaattaaaaaacttataacataaaaatagcagatataagttgttggatattgatacaccttatgacagggtcattgaattatattgatagggctgtagagtaggaggtcgaaatattgattaaagagaagtgtatagatgatttgacaatcgataataaatcagaaggacaggtgccgcgttctgccattatccttgctgcagggttcggtctacgaatgattccgataaatattgatagaccgaaagccttattgtccatcaatggtgaaagggttattgaacgcctcatcagacaattacgagaagctggggtggagtctataacagttgttgtaggctatatgaaagatgagttaacctacttaaaggagaagtatgatattaccttggtagaaaatgcagattattgtgatagtaataatttgtactctcttttcttggtctcagagaaaatttctaatacttttattctacctagcgatatttggtgtagaacaaatccgtttctatcggatgaaacggactcttattatatgatctatgaggatggggaaagccataagaaggaatactgggatgccatgactggtattgcttatattgatcataaagatggggtaaaacttagacaattactgcatgccatagcagagagtgagttggcgaaaacagcattttgggaagaagctctttatgacagtcagtcattgtggattcgccccaaaattgtccccttggatagtattaggcaaatcaatacttttgaggatttaagagagctagatagtcattcagaacatctacagtcagaggctattgatattatctgtcaaactttgcaggtggaaacaaaagatatcaatggaataactgctttgaaaaaaggaatgactaaccgttcctttctattttcttgtggaaataaaaagtacatcatgcgtattcccggagaaggaacagatttgttgataaatcggcaacaggagttctctgtctatcgaactctggatggtgccaatatatgtgatgaaattatttacattaatccagagaaaggctacaagattacgaaatttattgaaaatgcaagaagttgtgacttgaataatcggcttgacttagaaaagtgcatgtcaaagttgcgagaatttcatacattagaacttcaggtcaatcatgattttgatatttttgagcaaattgagttttatgaaactttattagatggagctaaatctatatacagtgattatgaacagattaaaaaacgagtcttcagccttacggcctatattgataaacatacagatagaaaagtcttgacccatatcgatgctgttccagataattttttgatttactctgaggatggagtagaagaaattcgtttgattgattgggaatacgcaggtatgcaagatccacatgtagatatagccatgttttgtatctattctctctataacaaggaacaaattgatgagctgatagatatttattttaggggttgttgccctacagaaattcgtatcaagatatattgctatattgctgcttgtggcttactttggagcaactggtgtgagtataagcgaagtttgggagttgattttggtgagtatgctgctagtcaatataaatatgctaaagagttcagtttagttttggagaacaatagtatcgtggaggaagtatgacatctaaagtaaaaggaacagttcaaggtttactgtccggtatgttttggggtttggatacagctttaaatggggttgttttaactttagctccctttattttaacagataatcggcttgtttcgggagcacttcttttagcatttttccatgatttcatttctgcattattactgactgtaggaatgggagtcagaggggaactgaaaggacttgtaagtttgttgaggaagagaagtgcccattttgttatactagctgctctatttgctggcccattagggatgcgtagttatttgatagctgttgatttaattggttcgagtttaacagcgaccatttctgcaatgtatccagctgtagctgctgttttaggtgcagttttcctaaaggactatttaaacaagagaggttggtttggcttagctctgactatcttagcaattattattttaggctacaccaatttatcatcctttaatagtcttttttggggtgttttagctgctttactatgtgtatttggctgggcttcagaaagtgtaatcactgcctatgggatgaaagaagatatttcacccaaacaagccttgctgattcgtcaatggacttccagtctagcatacttaatattcatgtcttttgaaggacagatagtatatagtttatctcaagttgtgacttcggcaagtatgttactgcttgttgtcttagctactattggtactctatcttaccgttgttactattcggctattgacacgattggtcctgtcaaagctacaggactcaatgttacctattccatttggacagttgttttttctatctttttattaggtggatttatggacgttagactaattatttgtggaatcttgattattgtcgggtcctcacttgttataaaaagctagttttagaaaggaataaatatgcgtgcaataattttagctgctggaatgggtacacgacttcgtcccttaacattgaccactcccaagtcattaattaaagtagggggagaaacccttattgaaaggcaaattaaatttctgagagaggcttgtgttaatgaaattattgtagtgacggggtatctttccgagaaatttcaatttctagaggataaatatgatataaagttggtatataatgacaaatatgatgtttataataatttttataccatgtatttagttcgtgaatatcttagtgaagcttatgttattgatgctgacaattatcttcatgagaattttctgcaaaattcaatgagagactctacctatttcagtgcctataagactaattttaaagatgaatggcttctaaaatgcaattctgataatttggttgaggaaatcgcaatagcgagcgggaatggttttattctatccggtgtttctttttggacaaaagaggctggagaaatactccgtgagattttggaagaggaaattaataaagaaggttttggtgatttatattgggacaatctggttaaagacaacctttccaaaatcaaggtagttaagcaagaaatttctagtacggctagttttgaaattgatgatcttaatgatttggaaaaattagaaaacttcctttcaacgattgaaaggaaccatctcataacaaagtaactgccccataacaaggtatctatccaatcactccctcctccagtatactgttataaaaaacaaaactggaggattttttatgtcacactccatcgtcccattgactgttccccaatctagacgtgttgagaagaaaggcagaaacgatattctgatgaaaattcgtctcggaaaagtggaagtcacattctttcactctatcaaccatgaagtaatggaaatgattttggataaggtgctgcactatgaccatccgactcagtgatttaggtcaagtctacttggtttgcggttacttatgtacgaagtagtggtgtgatttggttaagaggattatgttcacttagaatttctacctgcttgctttgagagacatgagtgtagatttgtgtcacattgatgttactgtggcccagtaaatgttgtatttgtcgaatatcgacgccattatcaagtaacatagttgcaaaactatgtcgaaacatatgtggagtgatatgttttttcagttgtagcgagtgagaaatattttttagaattaagcgcacactttgttctttaagatgattatcgtttcttgcaccggtaaatagatagctagaatgattgcaatgatgcgttatatagtcctcaagtaatgaaagtgtttcatcgtttccaatatagagtaatcgctctttctttccttttccgagtatatgaatggttctattttccaaattgatattatcgagttttaaactacataattcagagatgcgtagacctgttgataaaagtagcgagataaggagtagatttcgaattgctttccgtttagaatgtttatttttagaattttctacttgttggtgggcaaaacaatatattttttgtaaatctttcaaggaaatcgttttaggaagctttttctcttctttataatatagtcggagttgatggaagggattttttgagattagtttttcttcttccagaaatttatagtatgatttaagactagcaacctttcgttttaacgtgctagtcttttttatatgttgattaagaaaagtaagataggacttaatgtcattggtcccaaagttatgatattgatgtaaatcagatttgtatgctcggatagtatgagaactaagtcgcctttgaatagtgcaaaagtcaagatatctctggatagtgtcataattcataatgtaatctccttaatatgtcgtaataaagctattatatacgataatttatcaatttactaatgataataaattgttatcggtagaggaagtagagagaaaatggataaagttgatcctaataaagtcaaagaattttacaatacacatgaccaaatgtgggaaataaacaattggtataaatatagtcaaagtaccatcgtctcatttttacataaacaacactatattgggaatattttaaatgcaggttcaggtggaaacgattatggtatcacatctccaatgatacatttagatatttctgaagaaaaagttaaagatatagagggagcagttatcggaaacttagaagttcctagtctttttcagacaaatagttttgattctattatttgtgttggcagtgtgattaattattgcaattcctataaagttatagagaattttcaaaaatggcttatggaagagggggagttaattctagaatttgaaaatagtagttctttcgaatatctttttaccgcttttttcaacaagcctatgacaattgtttcaacaagttacattgattccaatcatgttatatatactttctcctttgattatattatttctcttttgaagctaaacaattttgaaattattgaaattactggttttcatattttaagttcgttagtcctaagatttttcaaatctgaaaactttgcgagtaaatttgtttttctagataaatttttaaataaaattttttatttaaaaaaacattctgcaaatatcattattagatgtaaaacaactagcactaaaatttaaatgctagttgttttctactatttcttatttgagttagtgaagatactacctattaaaggaatcgccattgtaccagcaataatggaagcgattatttcacctttatcaacgatatcattaaaaacaaaatgtacagcgattagacttaataccacccctatagctaaagaaatcatagctgccaataaatacctatatattccgttaaatatatatatcaaattatttgatttagttataggagttgatccggttgcttccttaaatactttataaccatcatctaaaatctggattgggtcagaaagtgtgtctattcttttttctatttttttgtaagttaagcttaattccttttgatattctgaaaaatcttctttggataatagtttctgataccattggaaataatagtcaaagaaaatcgactttatcaaacctccatatattgttttagaaagtgaattaagattatcagttgatttaatcattaggtatgcctcaaacccaggtatatcagtcatacctaagcttggtgttttaaaaggagcgtcaatttttttatatccttcaatatctagtattgtttgaaacatcttgctttcggaatcaattccttgaccattattgtcattgttgatatcagtaacccaataattaatggagtaatttttttcattactgaaatattgtccaagcagatttagacaagaaaggtataccacattttttcgatatgatttttcaactgcaatatattctaatatcattattttggtatgacttagaaagctagtcattgtcataccaataagtttttcattacagtatattttaaaaatatttattttaaactcttccacagtgttatcaatccaataaataaagtcatttggatcagtttttatagtaaccggagtaacattgtcataaatttttaatgcttttaaaaaatcatcgtcatcacccctgttgactagttctatagaataactttccctcatagattttcttcctctaccgataacaatttattatcattagtataccataatctacatttgttttatagattttattaaaatttttatagtaaatatttttagttttttgcttcaaaaatgtaatggaaattgatttttttgcaagtcattgtcataaaaatcagaaaatatttaataaatatgataaaatggaagtgatactagtttgaggtaaggatatgaaattaagaagaagcgtagaaaaactacagggaacgattcgtgtcccaggagataaatcaattagtcatcgctctattatttttggttcccttgcaaaaggtgttacccgtgtccacgatattttgcgtggagaagatgtcttgtcaaccatgcaggtctttcgtgatttgggtgtgaaaattgaagacaatggtgacattgttgaagtacacggtgttggctttgatggtcttcaagcacccaaaaatgatttggatatgggaaattctggaacctcgattcgtttgatttcaggcgttttagcgggtcaagattttgaggcgactatgtttggtgatgattccttatccaaacgtcctatggaccgagtaactattccactcagtcaaatgggagttgagatttctggacaaactgaacgtgacctacctccgttgaccatcaaagggaataagaatttaaaaccaattcgctaccaactccctgtagcctctgcccaagtaaaatcggctctgatttttgctgccttgcaggctgagggagagtcggtcatcgtagaaaaagagttgactcgaaaccatacagaagatatgattgtccagtttggtggacagttggaagtcaatggcaaggaaattcgcatccaaggtggtcaggagtttattgcccaagagattacagttccaggagatatttcaagtgctgctttttggttggttgctggcttaatcgtaccaggttcaaaaattgtccttgaaaatgtgggaatcaatgaaactcggactggtattctagatgtcattaaagctatgggcggaaaaatgactctttctaacatagatgaacttgcaaaatctgctaccattacagttgaaacgtcggaattgaaggctacggagattgcaggcgaattgattcctcgtttgattgatgagttgccaattattaccttactagcgactcaagcacatggaacaacgattattcgtgatgctgaggagttgaaagtcaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaacactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaagaattgctggacttacctagtaattgtatcgtgtcaactggtggtggggtgattaaatctgaagtaaacagggaattgctgttggcaaatagggaggacaatgtacttcttactgcctcctttgaagtttcctatcagagaattcgtaaggatagacaatcgcaaagacctctctttttacagtgtagtaaggaagagtttgaagccctctatcgtgaacgaatggcactttatcaaggtttagctgatactgtaatcgatacagataaactgaatccagaacaagtagcaaggaaaattttatgcaagtagcctatctaggacctcgtggttcttttacacatcaagtggcccagcaagcctttccgactgcggatttgcaggcttttgaaacgattacagaggttatcaaggcctacgaaacggggaaagttacctattccgttattccagtagagaactcgattgaaggtagtgttcatgaaacgattgactatctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagctagtacagcctatgctgctcgctttgtggcagaacaccctgaacaaccattcgcggcaattgctccgcaagcggcagcagttgaatatggactggaagtaattgcgcaagacattcaggaaatcagcgagaattttacacgtttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccggcccctgaaaacggctttgggtgagtattttttcatactggatcttgacaatcagtctgaggaattattagcctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggattatctattatataaaaaagagctgagagaacggcatggaagtccaaggcaatctctacgtggcttcacaccaatggcttatgaagatgacttcgaggaagattattttgaagaggatgatgagcaagaggaactgttgcctcgctatcctgaacgtaaatccagaaaaaccagacaagccaaacctcaacggtttcagtctcctcgtatcgagcccaaagcgaaagtacctaaacctaaaaaagctcgtaaaaagggtggtttcaagcgctttattggcttcgtattgcttgctatagcactagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggcgaaagttcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaataattttgacattgatatcaagtactatgcgatggtggattttgcaacctttgcgacaacgattgatacacttttccctgagggtgtaacgattgatgcacagttttcaactattaatggtgaagtcgttagctcagtagaagtgccgaatgatttacagctggaagaaaatgctcctgcttatcaaactattcaggtcggtgtacagcagatggatggtaagaccttgcttaactacgcgcgctatcgttcggatgatgaaggtgattttggtcgtacgagacgtcaacaggaagtgttatctgctgttatgacacaggctaaaaatccaatgaaactattctctggctccgaagctataggtaaggttgtggccatgactccgacaacagtgccacaaagctttatgtggctacagggaccaggccttctattggatgtggcaaatggtatcgaacgtgttacaatcccagaaaatggagactggattgacgactatgatatgtatggtggtatggctcttcgtgttgattttgaaaaatatcagcagcgcttggctgagttaggcctgcgttaagaaatatggtatactagaagtgacttcggtcacttttttagtggtccaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcaccagaccgtaatcaggacttggatttgacctatctaagaacaggtattgctgacttggggcatctcacttatccagcccaactagcttttaagaaaaaacaagttgagaatagtctacgtaagattgcaggcatttcagaaatagcagtagcagatacgttgggaatggacaatcctcttgcttatcgtaataaggcagctgttccaattcgtcgtgtgaatgggcagttagaaacaggattcttccgaaaaaattcacacgatttagttccgattgaggatttttacattcaacataaggaaattgatgccttggttctagcaactcgtgacctcttacggaaattggatttgaagccttacgatgagaaagaacagacaggacttgtgagaaatattgttgttcgtcgtggtcattattcaggtcagttgatgctagttttagttacgactcgtccgaagattttccgtgttgaaacccttattgagcgtttgacaagccaatttccaaatcttgtttctatcgttcagaatattaatgaccagaataccaatgctatattcggtcaagaattccgtcttttgcatggcagtgaagctattgcagataccatgttgggcaatgaatttgaaatttctgcaccgtctttctatcaagtcaacacagaaatggctgaaaaactctatcagacagccattgattttgcagaattgtcagcagatgatgtcgtgattgatgcctattcaggtattgggacaattggtctctcctttgcaaaacaagttaagcatgtttacggtgtagaagtcgttgaaaaggcagtccttgatagtcagaagaatgctgctcgaaatgggattgataatgttacctatgtctgtgatagtgcagaatccgctatgcaaaaatgggtggcagatggagtcaaaccaactgtgatttttgtcgacccaccacgaaaaggtttgacagaaagttttatcaaagcaagtacttctgtaaaaccagagaaaatcgtctatatctcttgtaatgtggcaaccatggcgcgtgatattaaactttatggggaattggggtacaaattgacgaaggtacagccgacggatttattcccaaatacgcaccacgttgaagttgtgagtctgttagaaaaacgcaattagattgtccagtatgctctcctgttttttggcaagctgcttcaaaggtccgcaggacctttgaactcccaaagagaatggcacttcaaaaataaaatgaatgaggggaaattgaagaatttgacggtatctctttgattgtttggacagccgataataagataaaagcgttgaaagagtttggttgtaattgtaacaactacaatccttacaaagagagtgaaacaccattatttagagatgaaaaagtaaattggttttgaggagataaaatattgatggaaagtagacctgagtttgacaaaattacatcgtttgatgaatttactaaatactattggtatcgtgaagaactttcacagatatgcaagtcattaggattagaatatagaggcacaaaacaggaactcaattatattattgagcaatactttaagggcaatttgattaaaaaatcatcaataaaaaatgaaaagaagcaagtggaaaatattactttagatacaccattacttgaatgtggtttttcttttaatgcaaagttcagagaatatttcactgttttaacaggtatctcaccatttaaatttactgctgatatggcaacagcttggaggaaagtaaaaagagaaaaggatttgagttttacaattcaagatatgctaaaagtttattatggaaaatcaaattatgctaagtatgacaattcgctttgtcaatggaatcaatttttaaaggatttctgtgcagacgaaaatagttgcaactactcaaacaaattaaaagtagcttctattctttggaaagaagtcagaaattcaagaaatgaaaaaatttattcaaagaatcttttgactgaatatgccgataaaataaaagagtattgcaagtaggatatttttagcttgctaaactaacaattcgataaaaactaacacatgaacagtaaatcaaaaagtgaacagatgttggaattttttggtaagtattcaatgtcaatgattttaataggaatagtcttagtaggaatcattattataggaattgcaataaatttatctattggacttgttcggtaactacatcatctcgtggttgatgatgccacaaatcaactcagctcttaattcaaaccgttttctacgattacgatagggctgtgccatgatttgaaaggttttaaatttggcattaaagtgctcgacttcaatacggattt

SEQ ID NO: 46 - DNA, 24866 bp, Streptococcus suis
gattccttagtcagttgattcgcttctttatttgattgatagaggtttttcaaagattggggtgaaattttacgacctgccatagttttccttttccgagtgtcacatctgaaagaaaatgctttcagatagggtagtttaatgatataattgtaagtaaatagagatttattgtcaaataaaaaagtaaaattggaaatgagaatattatgtcaaaatggaaaattgtcgcagattcgggctgcgactatcgtcaattagctaatctagctccgaacactgaatttattagtgtgccacttaccatccaagttggagaacaagcatttgttgatgatgcaagcttggatattgatcacatgatggaggtgatggaagcatctaagtctgcagcggggtcggcgtgtccaagtccgcaggcttatcaggcagcttttgagggagctgagaacattatcgttgtgacgattacaggagggctatcgggtagttttaatgcggcacgtgtagctagggatatgtatatcgaagagcatccgaatgtcaatatccatttgatagatagtctgtcagccagtggggaaatggatttacttgttgacgaaatcaatcgcttaattggtgcaggattagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtcaaagcaagttttccaacggctgttattgacgaagttacaacatcaggtctatgcagtttttatgctgaagaaggtggacttttgatgggctatgaagtgaaagcgtgattcacagagtaacaattttgggatgtaaatagaataatccccctcgtcttttaagttcgagggggattgtttgtatgaggttattaaatttcattcattcaaatatcttaggaattgctccagtttatctgcaaaatcttgttcaaagaagatctgtaaaaaatccgctttctgtcctctgaaataataacacttttcaaacatgtgttggatgctaggcgaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacatgccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatgtagatgatacgattatctgtatcaagatagtgtaaaggtaggctatgactagaatcgaaatctgctaaatagtcatcctcaatgatgtagacatcgtattgctttgctaattttacgatggctgtttttgttgctatatcataagttgaaccgagagggttgtgcaagcgaggaattgtgtagaaaaacttaatttttccagtctggaagatactttccaattcttctaggtcaattccatctaaatctcgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattctaacatagccttttggacagtgtctttgctacaatgatattgctcgctgagttgacggatagaaggtaatttctctccacgtttgaatcgatgttcctctattccagtcaaaatatcttggatgataacttgatattttttcatctaggccccctttttatagactatgttactagctagtatataggaaaaattgaagaaagacaacatctggatggggttgtggttcaggaattaagctactctatggtataattaagtgatgaaaataattatacctaatgcaaaagaagtaaatacaaatctagagaatgcctcgttttatcccctgcctgatcgaagcaagcaggttctggatgccataagtcaatttgatgtaaaaaagatggctgctttttataaattgaatgaagcaaaggctgagttagaagctgaccgttggtatcgaatcaggacaggtcaagcaaaaacctatccagcttggcaattatatgatggtctcatgtatcgttatatggataggcgagatatagattcgaaagaagaaaattatctacgtgaccatgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtattttctccacagattcagaaaagattagttaaaattcttttcatggaagaaaaagcaggtcagctaaaagttcactcgactatatcaaaaaaaggcagaggaagattgctgtcctggttggctaagaacaatattcagaaattatcggacattcaagattttaaggtggatggctttgaatattgtactgaaaaatcaacagagaatcagctgactttcatacgttcaatcaaaatgtgaaattatgaaaaagataacgttttccagcactaagtaaggataggaaaatattaatttctatgatataatgggtgcgttataagtaaaagtctaggaaggttgtttatgaaaaagagaagcggacgaagtaagtcgtccaagttcaaattggtaaattttgcgcttttgggactttatgccattactctatgtttattcttagtgactatgtatcgctataacatcctagatttccggtatttaaactatattgtgacgcttttgctagtcggagtggcagtattggctggattattgatgtggcgtaagaaagcgcgcatatttacagcgctcttacttgttttttcactggtcatcacgtctgtcggaatctatggaatgcaagaagttgtaaaattttcaacacggctaaattcaaattcgacgttttcagaatatgaaatgagcatccttgtcccagcaaatagtgagattacagatgttcgtcagcttactagtattcttgctccagccgaatacgaccaagagaacatcaccgctttattggatgacatatccaaaatggaatctactcaactagcaactagccccgcaacctcttacctgacagcatatcaatctatgataaatggtgagagtcaagcgatggtcttcaacggagtttttaccaatattttagaaaatgaagacccagacttttcttcaaaagtgaaaaaaatatatagtttcaaagtgactcagactgttgaaacagctactgagcaggtgagtggagatagctttaatatctatattagtggtatagatacttacggtccaatttcatctgtttcacgttcagatgtcaatatcattatgactgtcaatcgtgcgacacataagattttattgacaactactccacgagattcatacgttgctattgcagatggtgggcaaaatcaatacgacaaattaacacatgctgggatttatggtgttaacgcctcagtgcacaccttagaaaatctttatggtattgacattagtaactatatccgactcaactttacttccttcttgcagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcatagcagccctcataaaaaaattgagttcaccagataatctagcgaattatcaagctattctaactggtttggaaggatctatccaaacagatttgagcttagaaacaatcatgggcttggtaaatacccaattagaatcaggaacacaatttacagtagagtcacaagcattgacaggaacaggacgttcagatttatcttcttatgcgatgcctggatcacaactttatatgatggaaattaaccaagatagtctggagcaagcaaaggcggcgattcagtcagtacttgttgaaaaataaatattttaggagaaaatatgaacaatcaagaatcaaatacaatcgaaattgatgtattatcattattgaaaacaatctggagaaaaaaattcttcattctagtaactgcggtattaggagcaggactggcatttgtctacagcagctttttagtaacccctcaatttgactccactacacggatttatgtagtcagtcaaaatgttgaggcaggagctggtttgacaaaccaagaacttcaggctgggacctacctcgttaaagactataaagaaatcattctatcacaagatgtgttatcacgagtaaaaacagagctaggattgacagaggacatatcaaataaaatatctgtcagcatccccgttgatactcgtatcgtttctatctccgtgcgtgatgcggatccaaatgaagcggcacgtattgcaaatagccttcgcacctttgcggcgcaaaagattgttgaggtcactaaggtaagcgatgtgacgacacttgaagaagcggtacctgctgaacaaccatctacccctaataccaaacggaatatcttgcttggtttattagctggcggtatcttggcaacaggtcttgtactggttatggaagttttagatgatcgtgtgaagcgaccacaagatgttgaagaggtaatgggcttgaccttgcttggtgtagtaccagattcgaagaaattgaaataggagaacaatatggcaacgttagaaattgcacgtacgaaaaaagaattggtaaataagacagaagaatatttcaatgccatccgtaccaacattcagcttagcggagcggatattaaggttgttggcattacctctgttcaatcgaatgaaggtaagagtacaactgcggctagtctcgctattgcctatgctcgttcaggttataagaccgttttggtggatgcagatatccgaaattcagtcatgtctggtttcttcaagccaattacaaagattacaggtttgacggattacctagcagggacaacagacttgtctcagggattatgcgatactgatattccaaacttgaccgtcattgagtcaggaaaggtttcacctaaccctactgcccttttacaaagtaagaattttgaaaatttacttgcgactcttcgtcgctattatgattatgttatcgttgactgtccaccattaggactggtaattgatgcagctatcattgcacagaaatgtgatgcgatggtgcttatagcagaagcaggcaatgttaagcgctcatctttgaaaaaagtaaaagagcagttggatcaaacaggcacaccgttcttaggcgttatcttgaacaaatatgatattgccactgagaagtatggtgaatacggaaactacggcaaaaaagcctaatttctcagataatataagtttgataagtaggtattagtatgattgatattcattcgcatatcatattcggtgtggatgacggccccaaaactattgaagaaagtctgagtttgataggcgaagcttatcgtcaaggtgttcgctatatcgtagcgacatctcatagacgaaaagggatgtttgaaacaccagaaaaagttatcatgactaactttcttcaacttaaagcagcagtagcagaagtttatcctgaaatacgattgtgctatggtgctgaattgtattatagtaaagatatcttaagcaaacttgaaaaaaagaaagtaccaacgcttaatggctcgcgctatattcttttggagttcagtatgaatactccctggaaagagattcaagaagcagtgaacgaagtgacgctacttgggctaactcccgtacttgcccatatagaacgatatgatgcactagcgtttcatgcagagagagtagaagagttaattgacaagggatgctatactcaggtaaatagtaaccatgtgctgaagcccgctttaattggcgatcgagcaaaagaatttaaaaaacgtactcggtattttttagagcaggatttagtacattgtgttgctagtgatatgcataatttatctagtagacctccgtttatgagggaggcttataagttaataacagaggaatttggcgaagataaagcgaaagcgttgctgaaaaagaatcctcttatgctattaaaaaaccaggcgatttaaactggttactctagattgtggagagaaaaaatggatttaggaactgttaacgataaactgttaaaacgcaacagtaaacgattgatactcatgtgcatggatacgagtcttcttatagtttccatgattttgagcaggctgtttttggatgttattattgacattccagatgaacgctttattcttgcagttttatttgttttaatattctacctgattatctcagttagactaaaggttttttcgctaattacgaggtatactggatatcaaagttatgtgaaaataggactgagtttgatatctgcgcattcattgtttttaattatttcaatggtgttgtggcaggcttttagttatcgtttcatcctggtgtccttatttttgtcatttgtaatgctcattaccccaaggattgtttggaaagttttacatgagacgagaaaaaatgccattcgtaagaaggttagcccactaagaatcttagtagtaggtgctggagatggtgggaatacttttatcaataccgtcgaagatagaaaattggattttgaaattgtcggtatcgttgatcgtgatccaaataaacttggaacatttatccgtaccgctaaagttttaggaaaccgtaatgatattccacgattggtagaggaattagctgttgaccaagtgacgattgccatcccttctttaaatggtaaggagcgagagaagattgttgaaatctgtaacactacaggagtgaccgtcaataatatgccgagcattgaagacattatggcggggaacatgtctgtcagtgcctttcaggaaattgacgtagcagaccttcttggtcgaccagaggttgttttggatcaggatgaattgaatcagtttttcaaagggaaaacaatccttgtcacaggagcaggtggctctatcggttcagagttatgtcgtcaaattgctaagtttacgcctaaacgcttgttgttgcttggacatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatacaatccacatgaagcagtgaagaataatatttttggaacgaagaatgtggctgaggcggctaaaactgcaaaagttgccaaatttgttatggtttcaacagataaagctgttaatccaccaaatgttatgggagcgactaaacgtgttgcagaaatgattgtaacaggtttaaacgagccaggtcagactcaatttgcggcagtccgttttgggaatgttctaggtagtcgtggaagtgttgttccgctattcaaagagcaaattagaaaaggtggacctgttacggtcaccgactttaggatgactcgttatttcatgacgatacctgaggcaagtcgtttggttatacaagctggacatttggcaaaaggtggagaaatctttgtcttggatatgggcgagccagtacaaattctggaattggcaagaaaagttattctgctgagtggtcatactgaggaagaaatcgggattgtagaatctggaatcagaccaggcgagaaactctacgaggaattactatcaacagaagaacgtgtcagcgaacagatttatgaaaaaatatttgtgggtcgcgttacaaataagcaatcggacattgtcaattcatttatcaatggattactccaaaaagatagaaatgaattaaaagataagttgattgaatttgcaaaacaagaataagaaagtaaaagatatttttactttcctagagtttaaacgatgtttaaattctaggaaggttgaaatactttcctgaggtaagatatgctaggtcataggttagtaagagaaaaagaaaataggatcaaaggtggtctttaccataagattcaaatcgagctggctttcaactcaaaccacattgaaggcagtcaactgacgtatgaccagacaaggtatatctatgagaccaatacgattggttttgaagaaaattcaaccataaaggtggatgatattatcgaaacgaccaatcattttacggcttttgattttctcttagatagctttcaagatgatttgaatgaaacttggctaaaggagattcatgctatcttgaagagaggaacatctgattcaaggaagtcatggtttcaagtcggagactataaattatacccaaatgaagtcggcggtcgtgaaacgactctccccgagcatgtggagtcagatatgcaagaattgcttagaaattatcatgctctatcacctacttcctttgaggatattcttgactttcatgttcgatttgaacgcatccatcccttccaagatggtaacggacgagttggccgactcattatgttcaaagaatgtctcaaacatggacatgtcccctttatcatcggagatgacatgaagtatttttactatcgtggcttagccgagtggggagagcagaatggtttcttgctggatacttgtctagcagcacaagatagatttaagcagtatttggattattttaggattgagtaaatatacgtaatagaaggagaatagataaaatggcatttgattttacacaaaatttaaccccttttgagaacaaggtatggcttgcctctcccactatgcatggtgatgaattagagtacatgaaggaagcctatgataccaattggatgacaacggctggttcaaatatcaatgctctagaagaaatgataaaggaatatacaaacagtgaacaagtagttgcgctttcatcaggaacatctgctttacatttagccatgaagttggctggaataaagggtggtgactatgttttttgctcagatgttactttttctgccactgcaaacccaataacatatgagggtggaatcccagtgtttattgattcggaatatgaaacatggaatatggatccggatgcattggagaaagcatttgaaatttatccggatgtaaaagttgttgtgttggttcacttgtatggagtacctgcaaaaattgatgaaattcgagcaatatgtgatagacatggtgcacttcttatcgaagatgcagcggagtccttgggggcaacctataaaggacagcaaacaggaacctttggacaacattctattatttccttcaacggtaataaaattattacaggttcaagtggtggagctttattgaccagcgatttacaagcagcaaataaggttagaaaatggtcgacacaagctcgtgagcaggctacttggtaccaacatgaagagattggctacaattatcgaatgagcaacgttattgcaggtgtggtacgtgggcaaataccttatttagacgagcatattgcccagaaaaaagctatttatgaacgttatcaagatggattgaaggatttacctataaaaatgaatccgtttgattcaagcatttccgtaccgaattattggttatcttgtttaactataaatccagaagctatggcaaaacaggttcgttcggatagtgatgtcctctacacatctgagaaagggaaaacaactccgtcagaaatactagatgcactaaatgcaatcaatgcagaaggtcgcccaatctggaaaccaatgcactcacaaccaatttttagaatgaatccatttattacaaagcatggaaatggtagagctcaaaccaatgcctatattgcagggaactattcagatgtaggaacagacctttttgaacgtggtttatgccttcctagtgataataaaatgacagtagaagagcagaatattattattgagaccataagagcttgctttgaataaggaagtgttttaggagagatttatgaagaaagaaaaaagtcataaattgtaccgtaaaatgggattttatgaaagatacataaaaagagcgattgatgttttttgttcgggattggcaattatcgtattctgttggctgtatgcaatcatcgcttttctggttcggattaaactgggaagcccagtattgtttactcaatatagaccaggattaattgatccgagaacgggaaaagaacgaatttttaaaatgtataagtttcggactatgacagataagaaagatgcagagggaaacttgctgcccgatgaagtgcgtctgacaaaatttggtgcatggcttagatctacctctttggatgagctgccagaagcattttgtattttaaatggcacgatgacactgatagggccacgtccgcagttagttcgagatatggtgtttatgtcagaagaacaaagaatgcgtcatactgcaaaacctggattgtccgggcttgcacaagtaaatggtagaaatgcaatttcatgggatagaaaattgcagtatgacttggagtatatagagcatgtttcgtttggacgtgatttgaaaattctttttaaaactgttgaaaaagcatttattaagcaggaaggaattacagaagaaggtagtgtaactgctgcagattatggagattatcttctccaaacaaaacagataagtaaagaagaatacgataaaaaacagaacgaagcaaaagaactactaaaatgattgaagtaatgaacgagttagtttcaataataatgccttcatataatactgcgagatttattaataagacaatagaatctgtattagagcaaacatacaaaaattgggaactattaatagttgatgattgttcaacagataatacagatgagattgtatcgaagtatgatgatgaacgaattatttatctaaaaaacaaaaaaaattccggcgctgctgtatcaagaaataaagcattaaaaaatgcaaaaggtaagtggattgcatttttggacagtgatgatttatggtatccgaataagttagaagaacagataaagtatatgaaaaaaaataaatactccttttcatatactagctatgaagaaattgatgaaaatgatgtgacaaatggagtaaaagtaaccggacctaagaagattacgaaaatgggaatgtatcgttattgctggccgggatgcttgactgtaatgtatgatgcggagaagattggcaaaatacagattgcagatattaaaaagaataacgattatgccatgtggttaaaagtaatcaaaaaggcaaattgttatcattatgataaagtgctggcacagtatagaaaacggtcaggttcaatatctaatcatggatatataaaattagtaaaatggcactacaagttattcaaggaagcagataataagcatagtattgcatcgttttttttaactttacaaaatttaatctatggatgctggaaaaagatgcggtatgttaaaaaggtgagttaattatgggtatgaatgatatgctgcgtaaaatggctgttcttttagaaagaaggcaagacgcattattctcatatgatgtcaataaacagaaaaaatacattgctaaattaggaaatccacgagatgagattgaaagatcatattttcaatataagtgtcagatgcagtttaatggaaaaggaatcactttcttgttaaatctggtttcatttccagtagcgattctctattggttcaagtacggaaaaaaggttcaagtgaatcagctagagcagaaaaacttagtattttttagagatggtaaaccggaaaatattttgccaaaatctttgaaaaaaagatatagagctattgaatgtaatccagtagaaggaactttattaactgcaaaagataaaaagtttataaaaggaatcatatgtagatatccattttcttggcagtttattttaaaatgtttgattaaaattggaagatatagttttgccattgaagaatattcacctgaagcaatagcggtttgtgcggaatactcttttacgtcttcagtgttgacagcgtattgtaaacaaagaaatataaaacacatcgatgtcatgcatggagaaaaaatgtactatatgagagattcgttctttaaatttgatgaatgctatatttgggatgaatactacggaaaagtattagcttctatgaaggcagataaaaatcagtttgttgttgaggttccagcttctctgaaattcgatggagagttaatcagaacacagaaatatgattatacgtattatttaggtgcagaatcggaagaggtattaaagaaaatatcaaaaatattggaacagttacataagagtggaaagaaaatttcaatacgtccacatccgagatattctaatatggatcttgttaaaaagatatttgcttttgcaaatgtagaggatacaaccaacatttcgatagagcaatctttattacaatctggtgctgcaatttcgctttattcaacggtattgaatcaggcattatgcaattcaattccaataataatagataatatgagtaatcctgaaaattttaacaaattgaaagaattgggatatgtttgtctttataaggagcataaacttttatcagaagtagtggaggaaaaagcatgataggaacaattataaaaaaattgagaacagatttttatacaagtgtgtgtaaaaaaacagctaagcaatatggaaagggattgcatataaaccattggagtaaatttacttctaaaacgtatattggcgataattgtcattttaatggcatgaagattaccggaaatggaactgttacaataggtaacaattttcattcgggggggggtatactaattttaacatctaatcataattatgagggaagaacaattccttatgataatactatgatagatggtgatgttgttattgaggataatgtttggcttggacaaaatgtcacagttttacagggagttaaaattggagagggagcaattattcaagctgggagtgttgtagtttcggatatagcagcatgttcgattgcaggaggacatcctgcaaaagtattcaagaaaagaaacgaagaacattattatgaattgaaacaagaggagagttttttttgattaaccagttaatatcttgacctcattagaattaaaagtattagaggagcattaatgtgaaggtaagattaagaattaataatgcagcaatgatatatacattgtttgcaattgcttttatgggtggacatattttgaaaatacagtcgcttgtagcgaattttggtattgcattagttggtctttgtgcattttcgtatagtgttttgaaaaaaggaataaggggtataaatgcatatcttatcttgattggtgcattatattcagtatttatgatactttctcttttttataatggaaatgctgattatttggatctgttatggatatgggcatatatgggcattgctattttaacttatgaatttgaaatctctaaacgaacatattggaatgttgcgtattttattatagctttaatatgtatctatatggttaaaggtggaactgcagctagtctgctgtctatgggaagccaaaataatatttcggcatatgtaattttctttgtgataatggggtatttatctattatgaaggagaaaagagcgataaagtattattcgagttttttaacacttgcaatatgcctgtggacaggaagtagagctggtattatttcggcatctttattacttgtaggaacatttctatataatttcctcgcgattaaaggtcaaaagataaaatcactggctaagtggtgtgttttgatttgctttgcagtatgggcagtgactcacttccttggtaaatatttattagggttgacagctaaacttaataggtatggaagtggttcaatcaggacagagatatggagggaatatatacaaggtatagaggaaaatattggtaatttctttttgggagcaaatacatctaatggaacatatcgatggttgagcttttataatggaaatactcataattcatttttaatgttacatgcaaaatttggtttattagctctggggctattaatttttttaatttttttagttgttcataaagcaataaaagagaaaaattatattataataataattttgttaactgcgtcagctagaatgttctatgattggattgcttttcctggattatatgatgttcttttttggtatatgtatttatatatattaagtagacaggattatgaagacaggagattggagcaattaaatgaataaaggaaaaacagtttcgtttgtaaagattggtacggtgtatacacttagtaatatagtaattaagggaatggcctttttaacgacaccaatttttacaagattaatgagccaagaagaatatggaagttttagtaatatatcttcttgggcaaatattatattaattatagcttcattgtgcttgtattcatctattagtagagctaagtatgattatgatgaaaacataaaggaatatatgtctaccattacaattctgggaagtagttttacacttatagtgtggcttttaattgaaattaaaatggaattttgggaaggcatatttgatatggatggactgtacattcgtagcattatgctctattcactatttacaccagcagtacagacactgattactaaacatcgaatgtataatgaatataaaaatgttattgccttaacttggatcacattgcttgtttctacttttgcttcattaggattgacgtatgtaatgagcaataaattgatggggagggtaattggaaactatgcaattatagctgtcgttgatattgttttttggatatttattatatttcaggggaaatcattttcgctgagaatgtgtaaatatgcatgtgctttatctttgccattattgattcatgagctatcaggggtgctactaaattcatcggatagaataattattaatcaattatgcggagctaataaagccgctttatattcaattgcatatacaattgcaatggttattacagtggtattatcatctcttaatcaggcttgggtaccttggttttttgataaattggaaaagaatgaagtttcaataattagaaaagtagttccaaaatatgtaacaggattcacacttggatgcataggattaatgcttattgggccggaaatgatactgatttttggaggaaaatcttatgcagaggcggtatacgttattccgccagtatgtttggctatcgaggtgcaatttatgtatacattatatgttaatatagagttctttctaaaaaaatcgatatacatatcaattgctacagctggagcaacaataataaatattgcactgaattatttgctgataccaagatttggatatattgttgctgcatatactacggtaatcgggtatggggttgcgctgttgttccattatattgtttgtagacgaacaatatatagggatatatttgaagaaaagattatggtaataaatataggcctatgtttaggagcaatgcttttatccttagctttatatcaaaataacataataagaatattagtaattatcttgatcgtattaattgttattatatgtggaatacgaaatcgaaataagataaaaaaatattttggtaaatagagttgaggtgattttagatgaaaaaactgattctgataggagctggtggacatgcaaaatcagttgctgattcgattaacaaattagaatatgaattatgtggatttattgatagtaacaaaaagggtacacacatgggactacccatttggggtacagatcttgaagatatttctaactatgaagaatattgttattttgtttctattggagatgttggataccgtaagctgtggtttgacagaattaaaaatcgaagactgagtataatcaatattattgattcttctgcaattatatcgtccggtgtaaaaatgggaatagggaattttgtaggtaaaatggcagtaataaatgctgatgcagagataggaaataataatgttataaatacaaaagctttgattgaacacgaatgtaaagtaggcgatcataatcatttatcaacaaattctgttataaatggaaatgtaattgtaggaaatagtgtttttttgggcagttcatctgtgtgtaatggacaattgaaaatcggttccaatgcacttattggttcaggtagtgtgattataaaagatgtgcctgagaatgtaaccgtagtaggtgtacctgccagagttataaagaggagagattagaaatgagtaatattcaaattgttgcagagattggttgtaatcacaatggaagtgttgaattggcaaaaaaaatgatgaaagaagcgaaaaaagctggagcagatgcagttaaatttcaaagttttgtgccagaaaatcttgtttcaagatatgcacctaaagccgaatatcagaaaaaaaatgatggaaatggttcgcagttagatatgttgaaaaaattggcattaacggaaatggaatatttggaattggtacagtatgctgctactttagatattcagattttttctacgccatttgactttgaatctttttcatttttgcaaaaaatcggtcaaaatatatggaaagtgccatcaggagagattacaaatcttccttatttacagaaggtagcagcaattgaatgtcaaaataaacaagtaattctatcaacaggaatgtctacaattgatgaagttaaatttgcagtaaatgttttgcaacaaagcaaagacacaagttttacggtattacattgtaacacacaatatccaacagatccggaagacatgaatttgcgtgctatgaataagcttcaagaattagcaccagattggaaaattggactttcagatcattcagagggaattgttgcttctcttgtatctgttggattgggagctaaatttattgaaaaacattttactttagataaagctatgccagggcctgatcataaagcgtctattacaccggaagaattaaaagaattgtgtgtaggtgtacataaagctgaaataatgcttggaaatgaaatgaaagaagtaacagaatctgaacgaagcaatatttttgttgcaagaaaatctattgtggcaaaaagaaaaatcatgagaggtgaaatgttttccgaagagaatatcacctgtaaaagacctggaaatggaatttctccgatccattggtatgaagtgttggggaaagaagctgaaaaagattttgaaatagatgaattgatttcttgtaaaggggtgaatagagaagatgaataatttagcaataatacctgcaagaagtggttcaaaaggcttgaaagataaaaatataaaattattaaatggaaaaccgttaattgcatatagcatagaagcagcgaagaaatcaggaatttactcacacatattggtttctacggattctgaaaggtatggtgagattgcgatacaatatggagcagaagtgcctttttatcgttcagaagaaaatgcatcagatgtagcgtcatcatgggatgttgtaaaagaagtattgaaaaaatatcaggagatgggaattgaatttgatacatttacacttttacaaccaacatctccattgagaaagtacgaagatataaaaaaagcttatgaattatttaaagagaaagatgcaatagcggttgtatcagtttgtgaaatggagcattcgccattgtggagcaatactttaccagaaaataattcgttatctggatttttgcgatcagacagtaataaacaaagacagaagttggaaacattttataggataaatggggcaatttatatggcagatgtgaaggcttttttggaaaatacaaatctgtatagagaaggttgttacgcatataaaatgctgacagagcgcagtatagatatagatacagaacttgattttaaaattgccaaaactattataaatcagtgaaagaaggttagtatgggaaagtatagagtagcgtatgcgaccggttcacgagcagattatggaatagtaaaaaattttttaagattattagataatgacaaagatattgagttttcagtattggttacaggttcacatttggaagacaagtttggtcactctgtagatataatacggcaggatggattcaaaatcgatttagagattccgctaaatatagagaatggcagtaatgcgaatgtgatgcattgcatggcaactgcattagattgttttggaaattattttgaaaataataaatttgacttgttaatcatacttggagatagatatgaaatgatggcggttgcgattgcagcggctatgcaaagaatcccaattttgcatttacatggtggggaagttacatatggtaattatgatgaatttatacgtcattctattaccaaaatgagtcagtatcattttaccagtacagaagtatatagaaaacgtgtaatacagttgggagaagatccccaaagagtattttatcttggggcattaggggcagaaaattgttgcaagatagatgaagcaaaagtagttgaaaaggtaaaaaaacttattccgcagaaatactgggttgtagcttttcatccagaaacgctaacttatgtgagaatggaagaccaagtgaaggaagtattgactgcattgaagaaaaatctggatggaatgagcgttatttttatggggacgaatgcagatacaaaatctgatattatacgttcctcatggcttaattatgtagatgagcatgaaaatgcgtattactatgaaaatttgaatgtggattcgtttttgtatttagtaaaaaattctatagcactaataggaaattcatcttctggaattattgaaacaccgtcattaggaaagtatacaattaatattggagatagacaaaggggacgagtgcatggtaacagcgttattgatgttacttgtgacagtaacataattggtcaggcaatgaaagagattaccgagaaaagcgaagaaataattaatccatattatgtagaaaatactgcagaaaattattataaaaagacaaaagaaattttagaaaatggaacatccattttgaaagaattttatgatatagtctaaaattcagtagaaacagaagcgtaaagcaggaggtatgtgaacatgaaaattgcagtcgcaggaacaggctatgtcggcctatctattgctgttttattggcacagcatcatcaagtcacagctgtggatattatccaagaaaaagttgatttaattaatgataggaaatctccaattcaagatgaatatattgaaaaatacctagctgaaaaagacttaaatctagttgcaacgttggatgcagaaaaagcctacaaagatgcagaaattgttgtaatcgctgctccaactaactatgatagtgctaagaactactttgatactagtcatgtcgaagcagttgtacaaatggtattatcggtcaaccctcaagctttaatggttatcaaatcaacgattcctgttggttttacccaatctatgcgtgaaaaatttggtacggaaaatattatttttagcccagaatttttacgggaatccaaagcactttatgacaatctttatccctcgcgcatcattgtatcttatgagagtaattcaccacaaacagttattgagggggcgaagctttttgcaaaacttttacaacaaggtgctctaaaagaaaatgtcgaagtattacacatgggtgctacagaagcagaagcagtcaagctgtttgctaatacttatttagctttgcgtgtttcttacttcaatgaattggatacctatgcggagctaaaaggattagatacagaatcgattattcgaggagttggtttggatcctcgtatcggtgatcattataataatccctctttcggatatggtggttattgcttgccaaaagatacaaagcagttattggctaattacaatgatattccacagaacatgatgacagctattgtagagtcaaataggactcgtaaggattttattgctgatcaaattttgaagatagctggttattatgattattcgtcacatgatcaatactctcaatcgggagaaaaagaagtgatcatcggtgtgtatcgcttgacaatgaagagtaattcggataatttccgtcaaagttctattcagggagttatgaaacgtctaaaagccaaaggggcaaaagtgattatttttgaaccgactttagagaatggttccaccttctttggttcgaaagtgattaataatttgaatcagtttaaatctaaaagtcacgcaattgttgcaaatagatacgactctgtcttggatgatgtattagataaagtgtatacgcgtgatatttttaggagagactagtcttctaaagctacatttttaattgtgtgtttagatttctaggggagaaggctcgttgctcttctctttcttttttgactgtatgaacaataagtctggtaatctaactgtcaccaattgtaattgaaataggcgtgttagattgatacaattgttgataaacagaaataaagacttactttgtttcttgttagggaatatataaatgtaattttcagaggtaaataatgtcgtacgattatctagttgttggtgcagggctgttcggagcggtctttgctcatgaggcagctaaaaagggtaaaaaaataaaggttatcgaaaaacgagactacattgcaggtaacatctataccaaagaagtagaaggtattcaagtccatgaatatggcgcgcatattttccatacttctgaaaaagaaatttgggattatatgaatcaatttgcggcgttcaaccgctatacaaatacaccagtcgccaactacaagggtgaaatctacaaccttcccttcaacatgaatactttcaataaactgtggggcgtggtgacccctgctgaagctgaagcgaagattgcagagcaacgagctgtattgggaggaaaaacacctgagaacttggaagagcaagccatctcactagttggtacagacatctatgaaaaattgatcaagtcatacaccgagaaacaatgggaaaagccgtgtacggagttacctgccttcatcatccgtcgtttgcccgtgcgtttgacttatgataataactactttaacgatacttatcaaggtattccaatcggcggttatacgcagattgtagaaaaaatgttggatcatgaaaatatcgatgtggagacaaatgttgatttctttgccaataaggaagactatttagcgacctatccgaagattgtctttacaggaatgattgacgagttctttgattaccaacttggtgaattggagtaccgtagccttcgttttgaaacagaagtcttggatatggaaaactatcaagggaatgcggttgtcaactatacagatagcgagacaccatatactcgaatcatcgaacacaaacattttgaatttggtacacaagaaaaaaccattattacacgtgagtattcgaagacttggaaacgaggtgatgagccgtactatccagtgaacaatgatcgcaacaacaaactctatactgcttataaacgccttgcagagcagcaagaaaatgttatttttggtggacgtcttggtcattatcgttactacgatatgcaccaggttatcggtgcggccttgcaatgtgtgagaaatgaagttggggaatgattttgagaagtcatcaaggtagtaattgattcttggcagaagttgatactcttcgaaaatcaaaattatccgttgtcaacttgccttgatgagtgaaaagctccagtggaggttttcagcctgttaccttgaaataagatagtaacagagttctatcttcgacttcgtttcctaggctacttttgattttcgttgagtatgaaatgctctcaaaatattaatcaaaaaaaaccagaatttctggtttttttgattatcgaattgctgccaacaggtcagctgcttgttgctcgagttttgttagagtttcgtcagataactctaatacacctgttccccatgcttctggattgatggttgaacctgtaaattcaccagcaatctgagtacggataaatggaagaaggtgttggaagtctttgaataggtggtcgtgaccactgtttgcgacggcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaagaatgcttcggtttttttggccatttgatggttaaaagaaccgtcacgtagtgaaccaactaaaaacaatacgtttgccatgatggcctccttttcataaaaacataaatttagtatatcgtatttgtcttttgttggcaatcctaggtctgctggttcttgaattttttaagtatttcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttttttataacgacagtcatgttgccagaagtacttaataatttatcaattaagtcttgaatccgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtactttatatagcatagaggagctgaactgtgggtcccagttcttatatccgttcgctgtctgaaggagaatgaaagtttattcacaattcaattacggaaaaaatggaaatatgctttaacttgtagtataataggactactatggaaaaaaagatttttcaacttttggaagtattggcaacgaagaagggacagctgatagctggttcctttatactcctaagtgtcatgactttttcgatattcgttatttgggaccttgcagctaagcctttttctgatgtacagaatcatgctatttctgtagctcgagactatacggatatagaggttgttgatgatgtctctatctacaacgggacagaaacatactttagcctacaaggaaagacgagtcagggggaaatgattgcggttatcattcctgaagagacaaatactgtgtacgtttatccaatggcgaatggtatttctaaggaagaagcgcaggcagtcgctacagagaatggtgcgtcagcagctgatagggtgattctaggttttagggatgacaaaccaatttgggaagtcaaatcaggtactgcctactatttagttgaatttgaaacagggaactttatcaaacgggagggcttatgagcaagttatcaagacgagtcttagaaatggaagaaagtgtaa

SEQ ID NO: 47 - DNA, 33571 bp, Streptococcus suis
ttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcatgccatttctttttaaggttgctggaagtccgttcgtagtagtcttcaaggatttcttccttggacttgtaattgcggtagaaggcattgcgtgacacaccagcttttcggaccaattcagataccgaaatttgcttgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatggggtagtttaatgatataattgtaagtaaatagagatttattgtcaaataaaaaaataaaattggaaatgagaatattatgacaaaatggaaaatcgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtcggcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgtagacgaaatcaatcgcttaattagtgcaggattagattttccacaagtagtagaagcgataactcactatcgggaacacagtaagctcctctttgttttggcgaaagttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgttatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctacgaagtgaaagcgtgattcacagagtaataattttgggctgtaatttccgctatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacattttccaaacatgtgttggatgctaggagaaagaatccccttgcttagctgaaaggtcacgctccctttggaaattcgatacgggatgtttaaagcgtatttctctagacagtcttttattttattccattgagcgtgataaatgtgatgaagatgctgtgtgttccgcgcaaacataccgttatcaatgtagagcgagagagctttttgcatgataagattggtatcgtagtcgattagactcttatgtttgatgaagatatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatctgctaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaattccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcttttagacaaatccgaaaatcttcatagggtaattcttgaaagtctgtaggattgagctctacagtatggtcttggaaatctctatcctctaagatataataaccgcttttttcgacagcgtagatcttattttggtattttaattccaacatagccttttggacagtgtctttgctacaatgatattgctcgcggagttgacggatagaaggtaatttctctccacgtttgaatcgatgttcctctattccagtcaaaatatcttggatgataacttgatattttttcatctaggtccccttttttatagactatgttactagctagtatatagaaaaaattgaagaaagacaatatatgaataatggggttgaggttcaggaattaagctactctatggtataattaagtgatgaaaataattatacctaatgcaaaagaagtaaatacaaatctagagaatgcctcgttttatctcctgtctgatcgaagcaagccggtgctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggcagaggaagattgctgtcctggttggctaagaacaatattcaggaattatcggacattcaagattttaaggtggatggctttgaatattgtacttccgaatcaacggcaaaccaacttaccttcatacgatcaataaaaatgtgaaattatgaaaaagataacgttttccagcgctaaaaagggtagaaaaatattaatttctatgatataatggatgcgttataggtaaaagtctaggaaggttgtttatgaaaaagagaagcggacgaagtaagtcgtccaagttcaaattggtaaattttgcgcttttgggactttattccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcgctcttacttgttttttcactggtcatcacgtctgttgggatctatggaatgcaagaagttgtaaaattttcaacacgactaaattcaaattcgacattttcagaatatgaaatgagtatccttgtcccagcaaatagtgatattacggacgttcgtcagcttactagtatccttgctccagccgaatacgaccaagataacatcaccgctttattggatgacatatccaaaatggaatctactcaactagcaactagccccgcgacctcttacctgacagcatatcaatctatgttgaatggcgagagtcaagcgatggtgttcaacggagtttttaccaatattttagaaaatgaagatccaggcttttcttcaaaagtgaaaaaaatatatagtttcaaagtgactcagactgttgaaacagctactaagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctggtatctacggtgtcaatgcttctgtgcacaccttagaaaatctctatgggattgacattagcaattatgtgcggctgaatttcacttccttccttcaattaatcgacttggtgggtggaattgatgtatataacgatcaagaatttacaagtttacatgggaattatcatttccctgttggacaagttcatttaaactcagaccaagcattaggcttcgttcgagagcgctactctttaacagggggtgacaatgaccgtggtaaaaaccaggaaaaagtgattgctgccttgattaaaaagatgagtacgccagagaatctaaaaaattaccaggcaatcctatctggattggaaggctcaattcaaacggatttgagcttagaaacgattatgagtttagtgaatatccaactagaatcaggaacacaatttacagtagagtcacaagcattgacaggaacaggacgctcagacttatcttcttatgcgatgcctggatcacaactttatatgatggaaattaaccaagatagtctggagcaagcaaaggcagcgattcagtccgtacttgtttaaaaataaagattttaggagaaaatatgaacaatcaagaagtaaatgcaatcgaaatcgatgttttattcttactaaaaacaatttggagaaagaaatttttaattctcttaactgcagtgttgactgcggggttggcatttgtctacagtagttttttagtgacacctcaatatgaatccactacccgtatctatgtagtgagtcaaaatgttgaagccggtgcgggcttgactaaccaagagttacaagcgggtacctatttggtaaaagactatcgggaaattatcctatcacaagatgtattgacacaagtagcaacggaattgaatctgaaagagagtttgaaagaaaaaatatcagtttctattcctgttgatactcgtatcgtttctatttctgtgcgtgatgcggatccaaatgaagcggcacgtattgcaaatagccttcgcacctttgcagcgcaaaaggttgctgaggtcaccaagggaagcgatgtgacgacacttgaagaagcagtcccagcggaagccccaaccactccaaatacaaaacgaaatatcttgcttggtttattagctggaggtatcttggcaacaggtcttgtactggttatggaggttttggatgaccgtgtaaaacgtcctcaggacatcgaagaggtaatgggattgatattgctaggtatagtaccagattcgaagaaattaaaataggagaacaatatggcaatgttagaaattgcacgtacaaaaagagagatagtaaataaaaccgaggagtatttcaatgctatccgtaccaatattcagcttagcggagcagatattaaggttgttggtattacctctgttcaatcgaatgaaggtaagagtacaactgcggctagtctcgctattgcctatgctcgttcggattataagaccgtcttggtggatgcagatatccgaaattcagtcatgcctggtttcttcaagccaattacaaagattacaggtttgacggattacctagcagggacaacagacttgtctcaaggattatgcgatacagatattccaaacttgaccgtaattgagtcaggaaaggtttctcccaaccctactgcccttttacaaagtaagaattttgaaaatctacttgcgactcttcgtcgctattatgattatgttatcgttgactgtccaccattaggactggtaattgatgcagctatcattgcacaaaaatgtgatgcgatggttgcagtagtagaagcaggcagtgttaagtgctcatctttgaaaaaagtaaaagagcagttggatcaaacaggcacaccgttcttaggcgttatcttgaacaaatatgatattgccactgagaagtatagtggatacggaaattacggcaaaaaagcctaatttctcagataacataagtttgataagtaggtattaatatgattgatatccattcgcatatcatatttggtgtggatgacggtcccaaaactattgaagagagcctgagtttgataggcgaagcttatcgtcaaggtgttcgctatatcgtagcgacgtctcatagacgaaaagggatgtttgaaacaccagaaaaaatcatcatgattaactttcttcaacttaaagaggcagtagcagaagtttatcctgaaatacgattgtgctatggtgctgaattgtattatagtaaagatatcttaagcaaacttgaaaaaaagaaagtacccacacttaatggctcgcgctatattctcttggagttcagtatgaatactccttggaaagagattcaagaagcagtgaacgaagtgacgctactagggctaactcccgtacttgcccatatagagcgttatgatgctctggcatttcagtcagagagagtagaagagctaattgacaagggatgctacactcaggtaaatagtacccatgtgttgaagcccgctttaattggcgaacgagcaaaagaatttaaaaaacgtactcgatattttttagagcaggatttagtacattgtgttgctagcgatatgcataatttatatagtagacctccgtttatgagggaggcgtatcagcttgtaaaaaaagagtatggggaggacagggctaaggctttgtttaagaaaaatcctctaatgattttgaaaaatcaagtacagtaacctcatagaaatagtggaggagatatgagtaatgaaataggatatcgccaaacgaaattggcattatttgatatgatagcagttgcaatttctgcaatcttaacaagtcatataccaaatgctgatttaaatcgttctggaatttttatcataatgatggttcattattttgcattttttatatctcgtatgccagttgaatttgagtatagaggtaatctgatagagtttgaaaaaacatttaactatagtataatatttgcaatttttcttacggcagtatcatttttgttggagaataatttcgcactttcaagacgtggtgccgtgtatttcacattaataaacttcgttttggtatacctatttaacgtaattattaagcagtttaaggatagctttctattttcgacaatctatcaaaaaaagacgattctaattacaacggctgaacgatgggaaaatatgcaagttttatttgaatcacataaacaaattcaaaaaaatcttgttgcattggtagttttaggtacagaaatagataaaattaatttatcattaccgctctattattctgttgaagaagctatagagttttcaacaagggaagtggtcgaccacgtctttataaatttaccaagtgagttttttgacgtaaagcaattcgtttcagattttgagttgttaggtattgatgtaagcgttgatattaattcattcggttttactgcgttgaagaacaaaaaaatccaactgctaggtgaccatagcattgtaactttttccacaaatttttataagcctagtcatatcatgatgaaacgacttttggatatactcggagcggtagtcgggttaattatttgtggtatagtttctattttgttagttccaattattcgtagagatggtggaccggctatttttgctcagaaacgagttggacagaatggacgcatatttacattctacaagtttcgatcgatgtatgttgatgctgaggagcgcaaaaaagacttgctcagccaaaaccagatgcaaggtggtatgtttaaaatggaaaacgatcctagaattactccaattggacatttcatacgaaaaacaagtttagacgagttaccacagttttataatgttttaattggcgatatgagtctagttggtacacgtccacctacagttgatgaatttgaaaaatatactcctggtcaaaagagacgattgagttttaaaccagggattacaggtctctggcaggttagtggtcgtagtaatatcacagacttcgacgacgtagttcggttggacttagcatacattgataattggactatctggtcagatattaaaattttattaaagacagtgaaagttgtattgttgagagagggaagtaagtaaaagtatatgaaagtttgtttggtcggttcttcagggggacatttgactcacttgtatttgttaaaaccgttttggaaggaagaagaacgtttttgggtaacatttgataaagaggatgcaagaagtcttttgaagaatgaaaaaatgtatccatgttactttccaacaaatcgcaatctcattaatttagtgaaaaatactttcttagctttcaaaattttacgtgatgagaaaccagatgttattatttcatctggtgcggccgttgctgtccccttcttttacatcggaaaactatttggagcaaagacgatttatattgaagtatttgatcgagttaataaatctacattaactggaaaactagtttatcccgtaacagatatttttattgttcagtgggaagaaatgaagaaggtatatcctaaatctattaacttggggagtattttttaatgatttttgtaacagtaggaactcatgaacaacagtttaatcgattgataaaagagattgatttattgaaaaaaaatggaagtataaccgacgaaatatttattcaaacaggatattctgactatattccagaatattgcaagtataaaaaatttctcagttacaaagaaatggaacaatatattaacaaatcagaagtagttatttgccacggaggccccgctacttttatgaattcattatccaaaggaaaaaaaacaattattgttcctagacaaaaaaagtatggtgaacatgtaaatgatcatcaagtagagtttgtaagaagaattttacaagataataatattttatttatagaaaatatagatgatttgtttgaaaaaattattgaagtttctaagcaaactaactttacatcaaataataattttttttgtgaaagattaaaacaaatagttgaaaaatttaatgaggatcaagaaaatgaataataaaaaagatgcatatttgataatggctcatcataatttttctcagattttactggagagggatacagatattatcatcttctctcaggagaatgcacaccattagttccttcagaatacctgtataattattttaaatattctcaggatttatatgttgaatttacaaaagatgagcaaaaatataaagaaaataggatatatgaacgagttaaatgttacagattatttcctaatatatcagaaaaaactattgataatgtactgtttagaattttattaagaatgtatcgagcttttgaatactatttacaaagattgttgtttattgatagaataaaaaacatggtctaagaataagatttggttctaattgggtttcgcttccacatgattttgtggcaattcttttatcaaatgaaaacgaaacagcttatttatttaagtaatctaaatgtccagatgaactatttatacagacaattatagaaaaatatgaattttcaaatagattatctaaatatggaaatttaagatatataaagtggaaaaaatcaacatcttctcctattgtctttacagatgattctattgatgaattgctaaatgcaagaaatttaggttttttatttgctagaaagttaaaaatagaaaataaatctaaatttaaagaaattattactaaaaaataaaatagttgattttgtgagagtaatgtatgtttaaattatttaaatatgacccggaatattttatttttaagtacttctggttgattatttttattccagagcaaaagtatgtatttttattaatttttatgaatttaattttatttcatataaaatttttgaaaactaagctaatattaaaaaatgaaattttattgtttttattatggtctatattatgttttgtttcagtagtcacaagtatgtttgttgaaataaattttgaaagattatttgcagattttactgctcccataatttggattattgcaataatgtattataatttgtattcatttataaatattgattataaaaaattaaaaaatagtatcttttttagttttttagttttattaggtatatctgcattgtatattattcaaaatgggaaagatattgtatttttagacagacaccttataggactagactatcttataacaggcgtcaacacaaggttggttggctttatgaactatcctacgttaaataccactacaattatagtttcaattccgttaatctttgcacttataaaaaataaaatgcaacaattttttttcttgtgtcttgcttttataccgatctatttaagtggatcgagaattggtagtttatcgctagcaatattaattatatgcttgttatggagatatataggtggaaaatttgcttggataaaaaagctaatagtaatatttgtaatactacttattattttaaatactgaattgctttaccatgaaattttggctgtttataattctagagaatcaagtaacgaagctagatttattatttatcaagaaagtattgataaagtattagaaaacaatattttatttggatatggaatatccgaatattcagttacgggaacttggctcggaagtcattcaggctatatatcatttttttataaatcaggaatagttgggttgattttactgatgttttcttttttttatgttataaaaaaaagttatggagttaatggggaaacagcactattttattttacatcattagccatatttttcatatatgaaacaatagatccgattattattatattagtactattcttttcttcaataggtatttggaataatataaattttaaaaaggatatggagacaaaaaatgaatgatttaatttcagttattgtaccaatttataatgtccaagattatcttgataaatgtattaacagtattattaaccaaacatatactaatttagaggttattctcgtaaatgatggaagtactgatgattctgagaaaatttgcttaaactatatgaagaacgatggaagaattaaatattacaagaaaattaatggcggtctagcagatgctcgaaatttcggactagaacatgcaacaggtaaatatattgcttttgtcgattctgatgactatatagaagttgcaatgttcgagagaatgcatgataatataattgagtataatgccgatatagcagagatagatttttgtttagtagacgaaaacgggtatacaaagaaaaaaagaaatagtaattttcatgtcttaacgagagaagagactgtaaaagaatttttgtcaggatctaatatagaaaataatgtttggtgcaagctttattcacgagatattataaaagatataaaattccaaattaataatagaagtattggtgaggatttgctttttaatttggaggtcttgaacaatgtaacacgtgtagtagttgatactagagaatattattataattatgtcattcgtaacagttcgcttattaatcagaaattctctataaataatattgatttagtcacaagattggagaattacccctttaagttaaaaagagagtttagtcattattttgatgcaaaagttattaaagagaaggttaaatgtttaaacaaaatgtattcaacagattgtttggataatgagttcttgccaatattagagtcttatcgaaaagaaatacgtagatatccatttattaaagcgaaaagatatttatcaagaaagcatttagttacgttgtatttgatgaaattttcgcctaaactatatgtaatgttatataagaaatttcaaaagcagtagaggtaaaaatggataaaattagtgttattgttccagtttataatgtagataaatatttaagtagttgtatagaaagcattattaatcaaaattataaaaatatagaaatattattgatagatgatggctctgtagatgattctgctaaaatatgcaaggaatatacagaaaaagataaaagagtaaaaatttttttcactaatcatagtggagtatcaaatgctagaaatcatggaataaagcggagtacagctgaatatattatgtttgttgactctgatgatgttgttgatagtagattagtagaaaaattatattttaatattataaaaagtagaagtgatttatctggttgtttgtacgctactttttcagaaaatataaataattttgaagtgaataatccaaatattgattttgaagcaattaataccgtgcaggacatgggagaaaaaaattttatgaatttgtatataaataatattttttctactcctgtttgtaaactatataagaaaagatacataacagatctttttcaagagaatcaatggttaggagaagatttactttttaatctgcattatttaaagaatatagatagagttagttatttgactgaacatctttatttttataggagaggtatactaagtacagtaaattcttttaaagaaggtgtgtttttgcaattggaaaatttgcaaaaacaagtgatagtattgtttaagcaaatatatggtgaggattttgacgtatcaattgttaaagatactatacgttggcaagtattttattatagcttactaatgtttaaatacggaaaacagtctatttttgacaaatttttaatttttagaaatctttataaaaaatattattttaacttgttaaaagtgtctaacaaaaattctttgtctaaaaatttttgtataagaattgtttcgaacaaagtttttaaaaaaatattatggttataataggaagatatcatggatactattagtaaaatttctataattgtacctatatataatgtagaaaaatatttatctaaatgtatagatagcattgtaaatcagacctacaaacatatagagattcttctggtgaatgacggtagtacggataattcggaagaaatttgtttagcatatgcgaagaaagatagtcgcattcgttattttaaaaaagagaacggcgggctatcagatgcccgtaattatggcataagtcgcgccaagggtgactacttagcttttatagactcagatgattttattcattcggagttcatccaacgtttacacgaagcaattgagagagagaatgcccttgtggcagttgctggttatgatagggtagatgcttcggggcatttcttaacagcagagccgcttcctacaaatcaggctgttctgagcggcaggaatgtttgtaaaaagctgctagaggcggatggtcatcgctttgtggtggcctggaataaactctataaaaaagaactatttgaagattttcgatttgaaaagggtaagattcatgaagatgaatacttcacttatcgcttgctctatgagttagaaaaagttgcaatagttaaggagtgcttgtactattatgttgaccgagaaaatagtatcataacttctagtatgactgaccatcgcttccattgcctactggaatttcaaaatgaacgaatggacttctatgaaagtagaggagataaagagctcttactagagtgttatcgttcatttttagcctttgctgttttgtttttaggcaaatataatcattggttgagcaaacagcaaaagaagcttctccaaacgctatttagaattgtatataaacaattgaagcaaaataagcgacttgctttactaatgaatgcttattatttggtagggtgtcttcatcttaattttagtgtctttctgaaaacggggaaagataaaattcaagaaagattgagaagaagtgaaagtagtactcggtaagaatgttgtaataaatggttgaaagaaaaggggattaaaatgaatccaacaaatagtagaatagcactctttgatacgattaaatgtatcatggtactttgtgttatttttacacatctggattggtctgttgagcagcgtcaatggtttatctttccgtatttcgttgacatggctgttccaatttttctgttgctttctgcctattttcgaacgaataagtggaatacaaaacaagagacgctaaagctcaagttcagcagtggtataaaagaaagtataaacatgctttgtctctatgctatcgtgatggctgttaatgttttattgagctattcgagaaccatctgataggagtaaagcctttttcaggttcttcatcgctccgttcatttgtcctgtggctactttctggagaatcgggtccagggagttgggagttactatgttccgttgttgattcaggtagtttttttattaccaattttgtatgttcttttcgagaaaaataaatggttgggcttgcttacttgttttttagtaaacttttcagtggatgccatatttgctaacatggctgaacacggcatatatatatagactaatatcacttcgttatctttttgttctagggcttggttttttctttcaaagcaggatgtgcgttccaaggtagatactttcattgcgaccctatttgggattattggagcaattctgatttttgtgaatcattctatagagcccttctcctggttttatggttggaagtctacttcctttctatgcgtcccatttgcgtatgctatgctattttttatgataaagtatggacagaagattccagcaatactgttgtcaaaattgggagttgcttcttatcatatctacttgacccagatgctgtatttttcagtagtcgcaccatttttagcagtgcaatttaaggtatcttcgttgaatttgtggaacggcttgtttacctttctaatttgcctgtttggtggctatattttctacaaagtggatctgtttatgagagtacgtggaaaacgataatgactcatttcagattagcagatgccatttcgtttattagcagattcgcatgttaatattccgacaaagaaattcaaataggttgacgagagaggagtggtatctgtttctaaaccccagtatccccctttattttcaaagctatatttattaactgaacaaggagaatttttaagagaactgtttgtttaatcccagcacgatctggttcgaaaggcttaccgaataaaaacatgctatttttggacgggaaacccatgatttttcacacgattgatgtggcaattgaatcaggttgttttgagaaagaagacatctatgtcagtacggattcagaaatgtataaggggggcacctctataaattcccaaaattgcgaatttggagttacgaaagccttgttaaatcaacatcttaaattttagaaaattagtttttagaggtccccaaggggatttgcgagacaagaggcatcaatgtattgttaagacccaaagaactatctacttatcatactccatcgaatgaagtcagtacgcacttttttacgaatctggattttatgaagattgtatatttgttcttctgcaagtcacctcaccgttacgtactggcgaacagataaaagaagccatgaatatgtacttacagggggactcagaaaatgttttgcatttcaatgatgaagggcaagaaagagtgaatcagtacattatcgaagctgtacaggggttataaaaaggggttacttatccttaaagtctgtatgtagaaggagaaaaattgagacgaatttatatttgccatacgatgtatcagatcctgatttccttgttaaagatggacgttgagagagatagtttgatgtccgttgatatcatcgggcattttccagatgtcagggagcaactgcagcagcatgttcatctaatcgaggagacggagcgttcatttgatctatattctttgatagctagatcaaaaacaaaagaacgcctttccttgttacagagctatgacgaggtgatcatttttcaagatcaccgtcaagtcggtcattttttaaataaacatcggattccctattctcttttggaggatggttataattttttcaaggataaaagagtgtgcgatttggagtcaattcaatcatctgtctggaaaagactcttttatcaatggtattttaaaccaacatatttgattggttcaagtctctattgtcaatccattgaggtcaatgatctgtcgctcgtacaatttgacgaggcttataaaccctttgtagaagttccgagaaagcaattatttgatcaagcatcgccagagaaggtgcaagcgctgctgcagatatttggagcaagggcgatagtagcggatgaagagtcttctcaaaaacgattgctattattgacccagcccttgtcttgggattatcatgtgaccgaagaggagttgttggagatttatgtagcaggtcttgccccttatcgggaagactatacaatctacataaaaccgcacccacgagatggggttgattattcatttctgggtaaggctgtggtgcttctgcctcaaggtattccgtttgagttgttcgaaatggcaggtagtatccgttttgatatcggtatgacctatagttcgtctgctttagattttttaaattgttttgaagagaaagtgtatttaaaggacacttttcctcttctttcaaaaaatgatattttgcgtgaggggatagaataggaggattcatgtctaaaaaatcaatagttgtctcaggtctcgtctatacgattggaaccatcctcgttcagggattagccttcattaccctccccatctatactcgtgtcatttctcaggaagtatatgggcagtttagcttgtataattcgtgggtggggctagttggtctctttatcggtctacagttaggtggggcttttggcccgggatgggtacacttccgcgagaaatttgatgatttcgtatccaccttgatggtctcttctatcgctttctttttaccaatttttgggctatcttttctcctcagtcagcccctatcgctcctatttggtttgcctgattgggtcgttccgcttatctttttgcaaagttttatgagtgttgtgcaaggattttttacgacctatttagtgcagcggcagcagtccatgtggactttactcctatcggtactgagcgctgttatcaacactgctttatctttatttctcatcttttcgatggagaatgatttcatcgctcgtgtaatggcaaactcggcaacgactggtgtttttgcttgtgtgtccttgttgtttttctataagaagattgggcttcattttcgaaaggactatcttcggtatggtttaagtatatcgattcctcttatttttcatggattaggtcataatgtactcaatcaatttgacagaatcatgctcggcaagatgctaacactgtcagatgtagccctatacagtttcggctacacacttgcgtctatcttacaaattgtgttttcgagcttgaatacggtatggtgtccgtggtattttgagaaaaagagaggtgcagataaagatttgctcagttatgtccgttactatctggcgattggcctgtttgtgacttttggatttctaacaatttaccctgaattagcgatgttgttaggtggatctgagtatcgtttcagtatgggatttattcccatgattattgtcggggtgttctttgtatttctttatagttttccagccaatatccagttttatagtggaaatacaaagtttttgccaattggtacttttatagcaggtgtactaaatatttcagtcaactttgttttgataccgacgataggaatttatggtgctgctttggcaacgactgcttcctatctgttgttgctagtcttgcattattttgttgctaagaaaaagtatgcttacgatgaagttgcgatttcaacatttgttaaggtaattgctcttgttgtcgtctatacaggcttgatgacagtatttgtcggttcaatctggattcgttggtcactaggaatagcggttctagtcgtttatgcctacatttttagaaaggaattaacagttgccctcaatacattcagggaaaaacggtctaaataagggcacctctataaactcccaaaattgcgaatttggagttacgaaagccttgttaaatcaaacattttaaattttagaaaattagtttttagaggtccccatataaaaacgtcccaaatgagaggtgctcataagaattgaccatcactgccatctacccaaagttcaagtattctctaccatgaaaattgtgctataatcaagtataaagaagggaatgtttcttaaaggacgtatgcgcctctgcttatgccagaagtcatgaggtaaatctccctaaaaattgggtagaaaagcagattaaacttccaccaatctattgaagatcgtgtgaagaagcaggctttagaagcaacaagccctgagactattcgaaagaaatctagggctattttttctaatcggctatcagaagtgaagtagcgatctttattagtgttcttttactacttaaggaaaaccaagctgctccctcaagactttatgggagcgatttacagtcatttttagaaaggaaataaaatggtttatattattgcagaaattggttgtaatcacaacggtgatgttcatctagcacggaaaatggtagaagttgccgttgattgtggtgtggatgccgttaaatttcagacatttaaggcagatttgttgatttcaaaatacgcaccaaaggcagaataccaaaaaattacaacaggagagtcagattctcagctcgaaatgactcgtcgtttggaattgagctttgaagagtatcttgatttgcgtgattactgtcttgaaaagggagttgatgtgttttcgacaccttttgatgaggaatcattggacttcttgattagcacagatatgcccgtttataagattccatctggtgagattaccaatcttccctatttggaaaaaattggtcgtcaagctaagaaagttattctttcaactggtatggctgttatggatgaaattcatcaagcggtgaagattttgcaggaaaatggaacgaccgatatttcgattttgcattgtacaaccgagtatccaaccccttaccctgctttgaatttgaatgtcttgcataccttgaaaaaagaatttccaaacttaacaattggctattcagaccatagtgttggttcagaagtacccatcgctgctgcagcaatgggagctgaattgattgaaaagcactttactctggacaatgaaatggaaggaccagatcataaagcgagtgctactcctgatatcttagcagccttggtaaaaggagtgaggatagtggaacaatctcttggtaaatttgaaaaagagccagaagaagttgaagtacgaaataaaattgtagctagaaaatctattgttgccaaaaaagcaattgctaaaggcgaagtctttacagaagaaaacatcactgtcaaaagaccaggaaatggaatttcgccaatggaatggtacaaagtcttggggcaggtgagtgagcaggattttgaggaagaccaaaatatttgccatagtgcttttgaaaatcaaatgtaagcggagtaaggatgaaaaaaatttgttttgtgacaggctctcgtgccgaatatgggattatgcgtcgcttattgagctatctacaggatgatccagaaatggagctggatcttgtagtgacagccatgcatctagaagaaaaatatgggatgacggtcaaagacatcgaagcggacaagcgtaggattgtcaagcggattccattgcatttgacggatacgtctaagcagacaatcgtcaaatctttagcgaccttgacagagcaactcacggttctttttgaagaagtccagtatgacttggtgttgattctgggggatcgctatgagatgctaccagttgccaatgctgcgttgctttataatattcctatttgccatattcatggtggtgaaaaaaccatgggaaattttgatgagtcgattcgccatgccattaccaagatgagtcaccttcatctgacatcaacggatgaatttagaaatcgtgtcattcaactaggagaaaatcccaaccatgtactgaacatcggagctatgggtgttgaaaatgttttaaaacaagactttttgacaagagaagagttggcgatggaacttggaattgattttgccgaggattactatgttgtactctttcaccctgttaccttggaggataacacagccgaagaacaaacgcaggccttattagatgctctaaaagaagatggtagccagtgtttgataattggatccaattcggatacacatgccgataagataatggaattgatgcatgaatttgtaaaacaagactctgattcttacatctttacttcgcttccaactcgttattaccattccttggtcaagcattcacaaggtttaatagggaattcttcgtcaggtttgattgaagtgccctcattacaggttccgaccttaaatattggaaatcgccaatttggacgtttgtcaggaccgagtgtggtacatgttggaacttctaaggaagcgattgttggtggtttggggcaattacgtgatgtgatagattttaccaatccatttgaacaacctgattctgctttacaaggttatcgagctatcaaggaatttttatctgtacaggcctcaaccatgaaagagttttatgatagataggggagaaagtttgatgaaaaaagtagcctttctaggagcgggtaccttttcagatggtgtccttccttggttggatagaagtcgatatgaactcattggatattttgaagataaaccgatcagtgactatcgtggctatcctgtatttggtcccttgcaagatgtcctaacctatttggatgatggaaaagtagatgctgtcttcgtcactataggtgacaatgtcaagcgcaaggaaatctttgacttgcttgccaaagatcattatgatgctttgttcaacatcattagcgagcaagccaatattttttccccagatagtatcaagggacgaggggttttcataggtttttcaagttttgtaggagccgattcctatgtctatgacaattgtatcatcaatacgggtgccattgtggaacatcataccacggtggaggcccattgtaacattactccaggagtgaccataaatggcttgtgccgtatcggagaaggcacttatattggaagtggttcaacagtgattcaatgtatcgagattgcaccttatacaacattgggggcagggacagttgttttgaaatcgttgacggagtcagggacctatgttggtgtacctgctagaaagattaaataggtgaattgatggaaccaatttgtctgattcctgctcggtcaggatcaaaaggtttaccaaataaaaacatgttatttttagatggtgtaccgatgattttccataccattcgagctgcgattgagtctggatgttttaagaaagaaaatatatatgtcagtactgattcagaggtttacaaggaaatttgtgaaacaactggggttcaagtcctcatgcgtccagctgacttggcgacagattttacaacctcttttcaactgaacgaacattttttacaagatttttctgatgaccaagtatttgttctcctgcaagttacgtccccattaagatcgggaaaacatgtcaaggaggcgatggagttatatgggaaaggtcaagctgaccacgttgttagctttaccaaagtcgataagtctccaacattgttttcaactttagacgaaaacggattcgctaaggatattgcaggattaggtggcagttatcgtcgtcaagatgagaaaacactctactatcctaatggagcgatttatatttcttctaagcaggcttatttagcggataaaacttatttttctgaaaaaacagcggcctatgtgatgacgaaggaagattcgattgatgtagatgatcactttgattttactggtgttattggtcgaatttactttgattaccagcgtcgtgagcaacaaaacaaaccattttataaaagagagttaaagcgtttatgtgagcaacgagtccatgatagtcttgtgattggcgatagtcgtctgttagccttgttactggatggtttcgataatatcagcatcggtgggatgacagcttcgacagcacttgaaaaccaaggtctctttttggctactccgataaagaaagttttgctttctcttggtgtgaatgatttgattactgactatcccttgcatatgattgaggatactattcgccagctgatggaaagtcttgtttccaaagcagagcaggtttttgtgacgacgattgcctacacgctgtttcgtgatagcgtttcaaatgaagaaattgtgcagctgaatgacgttattgttcagtcagcaagtgaactgggtatttcagtgattgatctaaatgaagttgttgaaaaagaggcgatgcttgactatcagtataccaatgatggattgcatttcaatcagattggacaagagcgtgtgaatcagctgattttgacaagtttgacaagataatttggtgatagaagctatttcagtggctagactatgttggtatgtgttttagagccaaggaataacatctgtagaggatgctagccttgagaattgacaaccatttagttgtttaattatataaggggacctctaaaaactccctaaatttcccaaaaatgagataatagaataaaaagtaatgaggagagctgtcatgcatttattcacagacgatgaaaaaatcttgtcaaaactatcagagaaaggcaatcccttagaacgtttggatgccgttatggattggaatatctttcttccattgttgtcagagttattcagtcgtaaagataaagtcatcagtcgtggcggtcgtcctcacctagactatctcatgatgttcaaagcgctcttgcttcaacgtcttcataacctatctgacgatgccatggaatatcaactgctggatcgtatatcttttcgtcgttttgttggttgtcatgaagacactgttcccgatgcgaaaactatctggctctatcgtgagaaattaaccaagtcaggtcgtgaaaaggagttgttcgatttgttctatgcccatctcacagatgaaggggtgattgcccattcaggtcagattgtggatgctacctttgtcgaatgccctaaacaacgcaattcacgtgaggacaatcagaaaatcaaaacttatcgaaaattatgaggtcacaacagctagtgtacacgactccaatgtcctagctcctctttgtgatgccaatgaagcggtttttgatgacagtgcttatgttggaaaatcagtaccagaaggttgtcgccaccacacgattcgtcgtgcttttagaaataaaccgttgactgagactgataaggtcattaatcgacatattaccaaagtccgttgtcgcgttgagcatggttttggcttcattgaaactaacatgaaaggtaacatctgtcgagcaattgggaaggcacgagctgaaaccaatgtgaccttaaccaacctgctctacaatatctgtcgttttgagcaaatcaaacgactgggattaccatcgtgggcttagtgcgcccaaaaataggaaaataagcaaaaagaggctgggcaaaaactagtttctcacaataaaaaaacggctctttgtcaactgtagtgggtagacgaaaagctaacacctagagaggacgaaattcgttctctcatttttgatgtttaaagcgtaaccgcctaataacaaggtatctatccaatcacacattcctccattatatagttaaatgaaacaaaaacagtacatttatgatataatgtatttatggcatattcattagattttcgtaaaaaagttctcgcatactgtgagaaaaccggcagtattactgaagcatcagctattttccaagtttcacgtaacactatctatcaatggctaaaattaaaagagaaaaccggcgagcttcatcaccaagttaaaggaaccaagccaagaaaagtggatagagataaattaaagaattatcttgaaactcatccagatgcttatttgactgaaatagcttctgaatttgactgtcatccaacagctattcattaccccctcaaagctatgggatatactcgaaaaaaaagagctgtacctactatgaacaagaccctgaaaaagtagaactgttccttaaagaattgaataacttaagccacttgactcctgtttatattgacgagacagggtttgagacatattttcatcgaaaatatggtcgctctttgaaaggtcagttgataaaaggtaaggtctctggaagaagataccagcggatatctttagtagcaggtctcataaatggtgcgcttatagccccgatgacatacaaagatactatgacgagtggctttttcgaagcttggttcaaaacattcttactacccactttaggtaaaccatctgttatcattatggacaatgcaaagtttcataggatgagtaagctaaaagatttatgcgaggagcagggacatagacttttaccacttcctccttactcaccggaatataatcccattgagaaaatatgggctcacatcaaaaaacacctcagaagagtattgccaaattgcgatacttttcttgaggcactttcgtcctgctcttgtttcagttgactatactgttataaaaaacaaactggaggattcattatgtcacagcccgtcgtcccattgactattccccaatctcgccgctttgaaaagaaaagcagaaacgatattctgatgaaaattcgtctcggaaaaacggaagtcacattcttccaatctatcaaccctgaagtaatggaaacaatcttggataaggtactgcattatgaccatccgactcagtgatttaggtcaagtcttcttggtctgtgggaaaacggatatgcgtcaggggattgactctctcgcctatcttgtcaaaagtcaatttaatctggatcccttttcaggtcaggtctatctcttctgcggaggtcgaaaagaccgattcaaagctctttactgggatgaacagggattttggttattgtataaacgttttgaaaatgggaaattggcctggtcaaacaatgaagaagaagtcaaggctctaacttccgaacaagtagattagctcatgaaaggattttctatcattccaaaaataaatgtttcaaaaagtcgtgatttctattgaaatcatggcttttctttgtgtataatgagataaaaagaaggaggagcgagcgtatggatgagttgttggcaattattaaacaacagacctcaacgattgaacaacttaccaatgagctaaccctccttcgagaacaggttgactatctgagacagaaactctacggaaaatcatcagagaaagttgtgtatcaacccggtcagctgagcttgtttggggaggaaagcctccctgaagaagaagctgacttacccagttgaaacagagatcatcacttataaacgcaagaaaactaagggagttcgtcaggctatttttagtcagttcactccagagatagtgcatcacgaattgcagggcgaagactgcacttgtccagactgtcatggtcagttgaaagagattggctcagctgttcaacgacaagagttggtcttcattcctgcacaattaaagcggattgaccatgttcaacacgcatacaagtatcaggcatgtagccagaagaatctgagcgataagattatcaaggctcccgttcctaaggcacctttggcacacagcttgggttcagcctctatcatcgctcacaccattcatcagaagttcaatttgaaggtgccaaattaccgtcaggaagaggattggcataagcttggcctgcccatcagtcggaaggaaatagccaactggcatatcaagtctagtcagtattatttcgagccgatttacaacctgttgcacgagaaattgttggagcagcctattctccatgcggatgagaccgcctacaaggtcttagaaaatgatggtcagttgaccttcttgtctgggaaacatgaggaaaatggaattaccctctatcatcatgacaaacgacggagtggcttggttgtggaggaggttcttggggactatgcgggctacgtacattgtgacatgtggagtgcttatcgtcaattagacaaggctcagctggttggttgttgggctcccgtcaaacgaaagttctttgaggcgactcctaagaagacagacaagacttctttaggagcccaagggcttagcctattgcgaccgcctgtttgccttggagagttgactgggctgacttgtctagcgaggagcgactgcataaacgctggctcccttgatggacgagttctttgactggtgtcgtgagcaatctgttttgccaggctccaaattgggtactgctttggagtatagcctcaaatacgaaaccaccttccgaaccgttctctcggatggtgacttggtcctgtctaacaacatggctgaaagggctatgaagaccttggtgatgggcagaaaaaattggttgttctcccaaagttttgagggagccaagtcgacagctatcattttgagtcttttggaaacggccaagaggcacgaacttgatacagagaaatatatgacctatcttctagacaatctacctaacgaggaaacactcgctaaaaaagaagttctagaggcttatttgccatgggagaagaaaattaagagagcatgtaaatagaaaaaggttccagagtcaacaggactttggagccttttcaatataccttattattgggcggttacaaagtagcctaggaaacgaagccgaagatagaactggagttggagttcatcaaggcaagttgacaacggataattttgattttcgaagagtatcaataaaaatcaaagatagcaagtctaagctacttatgaaagttctataatgaagtcaaacgtgggacaactttacaacaagtgcgaaaagggttgtacaaaaaagtctattctgctgactatgcacaaacggtataccgaactaatcgaaaacgatcggtaaaaaagataatcctaacgaaagaattgaaagagaaaattttacactatactaagcaaaaattttctcctgaaatgatggttaagaagaagaaaatgaaagtgggtatttcaaccatttactattggtttcatcatggccatttaggattgacgaaagcagatatgctttaccctagaaaagggaaaagggtcaagaagcaagctagtcctaactttaaaccagcaggaaaatctatcgaagaacgtcctgacgttattaatcttcgcttggaaaacggtcattatgaaattgatacagttctactaaccagagggaaaaatcattgcctcttagtcttaaccgaccgacgaagcaggcaccaaatcatacgattaattccaaacaaaaccgccgaatcggtcaatcaggcactggagggaatcttgagggaacatcgtatcctgtctataactgtagataatggtacagaatttagtcgtctggctgaagtgtttcctgaggagtatatctactatgcgcatccctattcttcatgggagaggggaacgaatgaaaatcacaatcgattgattcggagatggttacctaaaggaaccaagaaaacgactccaaaagaagtcgcttttatcgaacattggatcaacaactaccctaaaaaatgcttggactacaagtcgccgagtgaatttcttatgggtggctaatttcaacttgaaatttggggtctaagctacttataacatttgaaaccttaatttataagtttgagttgaggattgtggatttcaagcagctgttttcttctaaaaaaataacaaaatcgaaacggtccatatccactttgagtggtagttggctatttttgattttaaatgagtatcacaccccatcgtcccattgactgttccccaatctcgccgctttgagaagaaaggcagaaatgatattctgatgaaaattcgtctcggaaaagtggaagtcacattctttcactctatcaaccaagaaacattagaaacaatcttagataaggtactattttatgaccatccgactcagtgatttaggtcaagtctacttggtttgcgggaagtagtggtgtgatttggttaagaggattatgctcacttagaatttctacctgcttgctttgagagacatgagtgtagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagacttaagcgcacactttgttctttaagatgatcatcgttttcacactggtaaatagataactagaatgactacaatgatgcgctatatagtcttcaagtaacgaaagtgttttatcgtttccaatatagagtagtcgcactttctttccttttccgagtatttgaatggttctattttccaaattgatattatcaagttttaaattacataattcagagatgcgtagaccagttgataaaagtagcgagataaggagtagatttcgcatagctttccgattagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttacgttttaatgtgctagtcttttttatatgttggttgagaaaagtaagataggacctaatatcattggtcctaaagctataatactaatgtaaattggatttgtatgcttggatagtatgagaactaagtcgtctttgaatagcacaaaagtcaagatatctctggatagtgtcgtaattcataatataatctccttaatatgtcgtaataaagctattatatacgataatttatcaatttactaatgataataaattgttatcggtaggagatcttatgaagcaattgctacagtattatttacaaaattttgataaagagtgctctaagaccaatttatttttagttgctaatttacaaaaacaaactaaaaaaatgtcttattatacaattgaacatgcatctggtcgtgaatttttttcgctatcagaatttgaggaaatagcttcagcactgttaaaaactggtttatgtttgaacattttttatactgaaatagatttcgtggagtatatattaaaatactattagcgcttatcaaaagaaactttgttagtttataatttggctagagacggtcgaaaagaaggaaaaaaatcgctgattccctctttttgcgattactttagcattaattatacaggttcaaatgcactaacagtttcattatgtcgtaataaatttatttggggagctattgcagattactttaatattccaacacccaaaactgtttgtataaaagatggcgaggtattaggtgagccttttgaagctcaaaaatatattagaaaagaaatttcggaatctgcaagtattaatctttccaatgattcaataatgaataattttgagtggaaaaatatagaaaaaaagattttctgttgcaagagtgtatttcaggaattgaagttgaagtcccttttttaatattaaagggaaatatcttgtattagatccagtcaaaattgtctcttcttcagaaattataacaagcaaactatctgataataatagttattcatttgaatggttggaagatcaacaaatatgtacaaaattaaaagagtcaacaaaaaaactcgccaagtacttaggtataaccacttacggacgagttgattttagaataaagtcagatgggagttattttgtttttgatattgcaacaatgccttacacaactgaccatcgttcatttaattttaactttgagcaatatggacttacaatgactgatcttcataaactagtaatattaagtagtttataatgcactagtatactgtatatcagttagcataaggcctcttcgaaagtaattccattctcttgaagcaaacttggattgtgatagaaattcagaaaattcctttcctgtttttatatttgattcgaaaatctttttatagcgacgatgtttttcaattaataattttttatttgaattgaaaataataggtgagaaatcttttaattgattgtatttattttttgcttgtcgatgcttactctctagtaacaacaagcaaaattcaaaccatccaaaataataacgataaaaatcatctattgaggtatcttcaaggtcggctaagtcctcaacatccatcaattcttcaagtatcgttttatagcttctgtacccttttgttttagaataatatagagaaattgcacataaatttgtatacattaagtgtttactcacatcatttaactcatattcagtaagaatgctttcaaaccgagatttccaataatcaaaatctccttccatacctgaaagaaagtccagtacaacaaaattatttttagatttccagtatagtgggagattgtgtttatctgatagtgtttctatttcttgtttcacctgatttgctcgctcatagttggaagaaacaagtaataatcctagaagactaccaagtgtataatactgttcaatttcatcatcgacatcgttaaaaaattttaaagctttattggcatcattgattgatctatcattatccttgtataaaaaactttttcttaaatatatattttcaagatattgtgcattttgctcaatatcttttgttgtataaaattttttgacaatattttcatttaaaacttggaatttatcaatttcattaagtttatctatattaagtttatctattaaatgaggtaatagcatgtaaatacatgaaagatagtgaataggctcaacaataacatctttggcgctttcagctaatatattttcgtaaagtgtatcacaaagtgaatgaaaagaaaaatcttgtgatgtatttccttgaaagttaatatcattctttaataatatcgaagataataatgaattttcgggtaaaatttcattataaagagagttagtaccatttgtatatttgtatttgatacatttaaaaaatattgatttagtctcttcagtgagaaattcaagtttatataaactctttttttcgctttctagtatctcgttttgatttaataaatattcataccagagtaagtatagtgataataaatattcttgactctctttaagtcttgataagatttctatctttaatctgtaattaaatggctcctttccgcatagataatgatagtaccgtctatagatttctttttgtcctttttcaaccgttaaaagaagcttatctttcataatcaatatcagactataaaaatttgttctattttttacaggaatcaagactagtaatttttttaagatatcaatagctttttcaatttgaaaagtttttaaattaaagtattcttcggcatcatacgggttgaaatattcaggaaggactgatagctgataaatgaaatcaatttcaattttattctttctaaagtctatttcaatcgtatttaacaaatcatctaataacttttcaatcttagaattattctgtgatagtaaaataaaattataaattttttccaagtttccctttgttagaggatacagtgtatcctctaagttatcagagatgtttgaagtttgtataatattacctaaagtatcttttaaatcgtttaattcaaaatgatgaacatcaaagttttttgaaaatctaatatcattattttttaactccgagcctccaattacaataataatcgatttattatattgcttttcataatgggagatattattgagaaggcgtataaaaaataattttagttcactccctagccactcccaatgttggattagaaatattaatctgtaattgttgctattatttagtattttcttctctatctcagttgaatcatattttaatgacagaccagctgttccaaatccttgtatcgagttattaacagatactgaaataggcttgaaaaatttttctgcaaatgaaagtttatactcgtctgtaatattgttatctccgaaatcactatacaatactgtaccattcccgtcaatttcgctttccaatagttcctgtgatattgtatcaaatgctaaggattttgataaagaatcttcgaacgggatatatagtgaaagtgacttttgatctgtatgtgcttgaataattgaataagtaatttctgttaaaaattgattccaatgagacataattaaactttcctaccgataacaatttattatcattagcataccataatctacatttgttttatagattttattaaaatttttatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaggaagcgtagaaaaactaaaggga

SEQ ID NO: 48 - DNA, 22371 bp, Streptococcus suis
atagagatttattgtcaaataaaaaagtaaaattggaaatgagaatattatgtcaaaatggaaaattgttgcagattcgggctgcgactatcgtcaattagctaatctagctccggacactgaatttattagtgtgccacttaccatccaagttggagaacaagcatttgttgatgatgcaaacttggatattgatcacatgatggaggtgatggaagcatctaagtctgcagcggggtcggcgtgtccaagtccgcaggcttatcaggcagcttttgagggagctgagaacattatcgttgtgacgattacaggtgggttatcgggtagttttaatgcggcacgagtagctagggatatgtatatcgaagagcatccgaatgtcaatatccatttgatagatagtttgtcagccagtggggaaatggatttacttgttgacgaaatcaatcgcttaattggtgcaggattagatttttcacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatctccctcgtcttctaagttcgaggggggattgtttgtatgagactattagatttcattcattcaaatatcttacgaattgctccagtttatctgcaaaatcttgttcaaagaagatctgtaagaaatcagctttctgtccgctgaaataataacatttgccaaacatgtgttggatgctaggcgaaagaatccccttgcttagctgaaaggtcacgctccctttggaaattcgaaacgggatgttcaaagcgtatttctctaaacaatcttttattttattccactgagcgtgataaatatgatgaagatgctgtgtgttccgtgcaaacataccgttatcaatgtagagcgatagagctttttgcatgataagattggtatcgtagtcgattagactcttatgtttgatgaaggtatcacgtagctgattaggaaggctgattgcaccgattcggagggcaggaaagagtgtcggtgtaaaagattttatgtagatgacacgattatctgtatcaagatagtgtaaaggtaggctatgactagaatcgaaatctgctaagtagtcatcctcaatgatgtagacatcgtattgctttgctaattttacgatggctgtttttgttgctatatcataagttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagggcttgttgactaccagctgtgataaccagatggtctttttttgtatagacatgatagtccattaacagactttgaacggaggaaattaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcctctaagatataataaccgcttttttcgacagcgtagatcttattttggtattttaattccaacatagccttttggacagtgtctttgctacaatgatattgctcgctgagttgacggatagaaggtaatttctctccacgtttgaatcgatgttcctctattccagtcaaaatatcttggatgataacttgatattttttcatctaggcccccttttttatagactatgttactagctagtatataggaaaagttgcagaaagacaatatatgaatgatggggttgaggttcaggaattaagctactatatggtataattaagtgatgaaaataattatacctaatgcaaaagaagtaaatacaaatctagagaatgcctcgttttatcccctgtctgatcgaagtaagccggtgctggatgccataagtcaatttgatgtaaaaaagatggctgccttttataaattgaatgaagcaaaggctgagttagaagttgaccgttggtatcgaatcaggacaggtcaagcaaaaacctatccagcctggcagttatatgatggtctcatgtatcgttatatggataggcgaggtataggttcgaaagaagaaaattatctacgtgaccacgttcgtgttgcgacagccttatacggattgattcatccttttgaattcatttcacctcatcgcttagattttcaagggagcttaaagataggcaatcagtctttgaaacagtattggcgaccgtattatgaccaagaagttggtgatgatgaactgattctctcactggcttcgtcagaatttgagcaggtgttttctccacagattcagaaaagattagttaaaattcttttcatggaagaaaaagcaggccagctaaaagttcactcgactatatcaaaaaaaggcagaggaagattgctgtcctggttggctaagaacaatattcaggaattatcggatattcaagattttaaggtggatggctttgaatattgtactgaaaaatcaacagagaatcagctgactttcatacgttcagttaaattatgaaaaaaagaataagatatgaacaagattgaacaagataacgtttttcatcactaaatatggctatgtggctagtaaaatattgttttttgtgatacaataggtgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcactggtcatcacttctgtcggaatctatggaatgcaagaagttgtaaaattttcaacacgactaaattcaaattcgacattttcagaatatgaaatgagcatcctcgtcccagcaaatagtgagattacagatgttcgacaggtcactaatgtacttgctccggctgaatacgatcaagacaacatcactgctttattaaatgatatttctaaaatggagtctactcaattaactacaagtccgacgacctcttatctaacagcctaccaagctatgctaaatggtgagagtcaagcaatgattttcaatggagtttttaccaatattttagaaaatgaggatccagacttctcttcaaaagtgaggaaaatatatagttttaaggtgactcagactgttgatacagctactaagcaggtgagtggagacagttttaatatctatattagcggcattgatacatatggcccaatttcgtctgtttcgcgttcagatgttaatattattatgactattaatcgtgctacacataagattttattgacaactactccacgagattcttatgttgctatcgcagatggtggacaaaatcaatacgacaaattaactcatgctggtatttatggtgtcaatgcctctgtgcataccttggaaaatctttatggtatcaatatcagtaattatatccgtctcaactttacatccttcctacagttgattgatttggttggaggtatcgatgtagaaaacacccaagagtttacaagtttacatggaaactatcatttttcagttggtaggattcatatggatgcagaacaagcacttggtttcgtgcgtgaacgttattcactcgaaggcggagataatgatcgaggtcaaaatcaagaaaaagtcatttcagcacttataaaaaaattgagctcaccagagaatttgcataattatcgagctattttaaatagtttagaaggctctattcaaacagacctaagtattaaaacaattatagaacttgttaatacgcaattagaatccggcacacagtttaccgtggagtcacaagcactggctggaagtgggcgaacagacttaccctcttatgccatgccggattcacaactttatatgttagaaataaaccaagaaagtttggaacaagcaaaaactgctattcagtcagtattggatggaaattaaaaaataggagaaaacatgaataatcaagaaatgaatacaatagaaattgatattttattcttactgaaaacgatttggagaaggaaaatcgttatccttttgatggcactactaagtgcaggtttggctttcgcatatagtagttttttggtaacaccgcaatatgattcgacaactcgtatttatgtagttgggcaacatgctgaagctggtgtaggagtgactaaccaggatcttcaggcaggaacttaccttgtaaaagattataaggaaattattttatcacaagatgtactttcgcaggttgtatcggagttaaatttagaagataatttgaaagaaaaagtttcggtatcgattcctgttgatactcgtatagtttctatcactgtgcgtgattcgaacccaaatgaggcggctcgcatcgcaaatagcctccgtagttttgcggcacaaaaaattatagaggtcacaaaagtgagcgatgttacaacactcgaggaggctgtcccagcagaggagccatcaactcctaataccaaacgcaatatcttgctaggtttattagccggcagtatcttggcaacaggtctcgtgttggttatggaaattttggatgaccgtgtaaaacgtcctcaggatatcgaagaggtaatgggattgaccttacttggtgtagtgccagattcgaagaaattgaaataggagaaaaatatggcgacattagaaattgcacgtacgaagaaagaattagtaaataagacagaagaatattttaacgctatccgtacgaatattcaactcagtggggaagatattaaagtggttggcataacttctgtccaatcaaatgaaggaaagagtacaacagcagccagtcttgctattgcctatgctcgttctggctacaagacagtcctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttttgcaaagtaagaattttgagaacttattagctactcttcgtcggtattttgactatgtgattgttgactgccctcctctagggatggtaattgatgctgcaattattgctcagaagtgtgatgcaatggttttagtagcagaggcaggaaatgtcaaacgttcagctgtgaaaaaagtaaaggaacagttggagcaaactggaacaccgttcttaggcgttatcttgaacaagtatgatattgcaactgagaaatatggtgattatggaaattatggtaactatggaaattacggtaaaaaagcttgatttttatgatatgagctttgattaagtaggtgttagtatgattgatattcattcgcatattatatttggtgtggatgatggtccaaagacaattgaagatagtctagatttgataggagaagcttatcgccagggggttcgcttcatagttgctacttctcatagacgaaaagggatgtttgaaactcctgagaaaattattatgactaattttgttcaagtaaaagagagagttaaagtagcttatccggaaatgactttatgttatggagcggaattttactataataaagatattctaagtaaactcgaaaaaaaggaagttccaactcttaatggaacgcgctatattctcctagaatttagtaagaatactccttggaaagaaatccaagaggctgtgaatgaagtaatgttacttggactgactccactacttgcccatatagagcgttatgatgctctggcatttcagtcagagcgggtagaagaattaatcgacaaggggtgttatactcaaattaatagcaaccatgtgttaaaaccaggtttaattggtgaccgagcaaaagagtttaagaaacgggcacggtactttttagagcaggatttggtgcactgtgtggctagtgatatgcataatttgatagcccgacctccttttatgagggatgcttataagctaattaaaaaggaatttggcgaagataaagcaaaaaccttactgaaaaaaaatcctcttatgttattaaagaatcaagttttttgatttttttaatttcaagaatttgaggcatagatatggctaattatttatagcttatgtactttttattaaattggagagaatatgattaatacaaatgggcatcgccagatacgtttggcaatccttgagttagttgcggtagtttttgccgtatttataacaagtcaatttcctgattcggatctcaatcgtacaggtattttatcaattattgtactgcatttttttgctttcaatttatctaaactttatgtagaaattgaaagtcgaggatacttagcagaaatagaaaaaacattaatttatagtctaatttttgcatttctactgactttcgtatcgttcatgttggaaaaagaggttgagatatctagaagaggggttgtctatttttctattatcaatttttgtttggtctatctttcaaactgctttgttcggaaatacaaacatttttttctaattactaggaatcaacaaaagaatactttgcttataaccacgcctgaacgtttccaattaatgaaagatttatttgaatcggaattactatcaaccagatatttagttggagtcgtcattttgggcgagataacagatggactggagttagttactccaattatccctgttgataaggcagtggattttgcaactcatgaagtagttgatcatgtttttataaatcttcctagtgaattttatgatttgaaagtttttgtttcagaatttgaaatattagggatagatgttagtgttgatattaattcgtttgattttcaagctttgcggaacaaaaagattcagcaagttggtgatcacagtatagttactttttcttctaatttctataaaaccaaccatatctttttgaagcgccttcttgatattttgggttccatagttggtttgattatttgcggtttagtttctgtagttctagttcctttgattcggaaggatggaggaccagcaatctttgtacaaaaacgtgttgggaagaatggacgagtttttaagttttataaattccgttctatgcatattgatgcagaggagcgcaaaaaagagcttttagcacaaaatcagatgcaaggtggaatgttcaagatggataacgatccaaggattactccgattggtcactttatccgtaaaaccagtttagatgagttgccacaattttacaatgttctccgtggggatatgagtttggttggtactagaccaccaacagttgatgaatttgaaaaatattctcccaatcaaaagcgccgtttaagctttaaaccaggtattactgggttatggcaagtaagtggcagaagcaatataacgaattttgacgaagtagtaaaacttgatgtggagtatattgataattggacgatttggtctgatgtaaaaattctgttgaaaactttagtagtggtatttaaaagagaaggaagtaagtaggctacttttatattatattttaaaagggctaaaataagtcatgaagagtatttatattattggttctaaaggtatccccgcaaagtatggtggatttgaaacttttgtagaaaaattgactgaatacaaaaaatcaactgatgttcagtactatgtagcttgcatgcgtgagaattctatgaaatctggtcttacagatgatttttttgagtataatggtgccaaatgttttaatgtagatgttcctaatattggaccagctcgagctatcgcatatgacataatcgctctaaataaagccattgccattgcagaagaaaatcaggatagagcaccaattttttacattttagcatgccgaattggaccatttattttgaatattaaaagaagaatcgaagctatcggtggtactctttgggttaatccagatggacatgaatggttgagagaaaaatggagttaccctgttcgtcgttactggaaattttctgaacgactgatgataaaatatgctgacttagtagtatgcgatagtataaatattgaggaatatattcgacggtattataagaaatataatccagtaactaaatatattgcttacggtactgatgttgctagatctatattgactcaggatagtaagagcgttcgcacttggtatggtgaaaaacaattagtagagaataattattatcttgtagttggtcgctttgttccagagaacaactatgagactatgattcgtgagtttatgaaatcaagttcaaaaaaagattttgtcctcattacgaatgtagagcaaaatgctttctatcttaagctaaagagagagactggatttgataaagattcaagaattaaatttgtcggaacggtctatgatcaagagcttctgaaatatattcgagagaatgcttttgcctatctccatggtcatgaagtaggtggaacaaatccttcactactagaagcactgtcatcaactaagttaaatctccttttagatgtagggttcaaccgtgaagttggcgaagagggggcaatttattggaaaaaggataatcttcataacattattgaggaaagcgagcaattatctgaccaagaaattgaaaaaatgaatattagctcaaatttgcaagtacaaagtaagtttacttggccatttattgttgacgaatatgagaggttatttaaaggataggtaatgaaaaggatattgtatctccatgcaggagcagaactttacggagctgacaaggttcttttagagttaataaaaggtttaaataagaatgaatttgaggcacatgttatcctgccgactgacggaatacttgtatctgcactaaaagaagtaggcgcaaaagtagaaatcattaactaccctattttgcgtcgtaagtacttcaatctcaaagggattctgaactatttcatgtcgtataatcgctattctaagcaggttgcgaactacgctcaaagtaataatatagatttaattcataataatacaacagctgtattagaaggaatttatctaaaaaagaaattaaagcttccacttatatggcatgtacacgaaattattgtaagaccaaaagttatttctgattttattaattttttaatggggcattatgcagatagaatcataacagtttcaaatgctgttgctacccatataagaaaatctcgatttattgatgatgagcaagtgaacgtcatttataatgggattgataatacagtgtatcatcaaatagacgctacaaaggttcgtgaaaagtttggaatttctagagattctattgttattgggatggttggacgagttaatgcttggaaagggcaaggagattttgtagaggctgtaactccaattttagagaaaaattcaacagctattgctttcatagcaggaagtgcttttgagggagaggagtggagagttgaagaactagatgatagaatttcttcactttcagtttcttcacaaattaaacgcattgattattattccaatactactgaattatataatatgtttgatatatttgtactcccaagtacaaatccggatccactgccaactgtagttttagaagcgatggcttgtggaaagccaattgttggctatcgtcatggtggtgtctgtgagatggtggtaaataattcgaatggactactggtgactccaaactccgtaaaacatttatcaacagcaattcagtgtctattagaaaatagcgaactaagaaaagggtttggagaaaaatctgaaaagcgccagaaagagctgttttctctgcagagttatattgataattttgttgaagaatatatagaacaaattaacactagaaatactagtaagtcaaagtaaataaagtagttacagtttatgataaacgagacgctatcataatgcaaaattctatcggtaacctagggtatttgctgttaaactgtagttgtattagtggattaaaaaaagtgcatgagtaaaatattattgagtgttattattcctgtctatcaggttgagaaatatttaaaacgttgtattgacagtgtgttagcgcaaaaattcattgactatgaaataatattggttgatgatgggagtaccgactcgtcacctgaaatttgtgatgaatattctattgagcatcctcatatttccgtaattcataaggaaaatggtgggttgtctgatgctcgaaatgtcgggataaaacatgctgtaggagagtatatatttttccttgattcagatgattggattagtccaacaatgtttgaaagtttgaaagaaattatttcttctaaaaagcatgatattatacattttgacttacagttttgtaaaaacgaacaatttaattgtgtgaaatgtgaattgaatgaaaaggagttttcagggattgtagcatttcaaaaaatgttagaatgtacagatattacaagcttttcaacagataaattatatagagtttctttgttttcagagaatcgaatagaatttcctgtaggtgcgtactatgaggatttagggacaatttataaattgtttttagtagcagattcggtttattatactaatcaggtttattattattattttttaggtaacgaagcttcaattactaaatcatggtctgagaaaaagtttttagacatgtttcgattctattcggagatttttgaaatgtccttgcagaaccagtatattaacaacagattagctagaacttactacagtcatggccttgtttatatattgactaaattatatgaaagtcaaagttatgatttaatagcgaaagaaatttcacagaaattacgcgacaatagaattccgttacaatcattacgaggatattaccactataacaaatattttctatataggttaggattgcttaagattgttatcaatattaaagagtttttcaaaaagttagggtaaaagttttaaaatatgaaaaaaacattattattattcgaacaaattgagacatttgaacaattttttgctaccaatatatcacatccgctagttgatgtttataccccttatagagctgtctcatcacaagtagcacacaatatacgagcgatttctaaaagattaccaggagatttttttcaccggtactggcttgaagcttggaaagataatttagctaattatgatactatagttgtttttgataatgcaatcacaccaaaattattaaaatatattaaggagcatatttctagtcaaactgcgctaaaagtttggttatggaatgttccaaatgaacatattgattatttaaaagaaaattttgatgtctattgttttgataaaacatattcagaaaagcaaggattatcttttattgaacagttctatattttagataatattcgagaggaacagactgagttattacaagatttttattttataggtgcagataaagggcgtttagaacagctataccaattagctgaaattatcgaagattcgcaaatgacgtatttatttgatatttttagtaatgctagaaattctgactataaaggtattaattatttagatactaaaatcacttactctgaaattattgaaaaaatccaacaatccaaagccattgttgagataaataaagaagggcaaatgggactgacactacgggctttagagtcaattttctttaaaagaaaattgattacaacaaatagttgtgttaaaaattatgatttttaccatccaaataatatttttgtattggaacaatcaacagctgaagatttgatagaatttatgagtaaaccttatgtgtcattgccggaatctacaatagaaaagtattcatttagtaattggattagcactattactaaatagttatagaggtattactatgaagttgacattttgcctcccagagataagtcaagtaccaatgggagggtacaaaataatttttgaatatgctaatcgattagttgatagagggcatgaagtatctatcgtttttttaacacacacggtttggaatcgtttgacaaacaatagcttcattaaatcaattgtagggcaattaagaggtagaaatgaaccttcatggtttagtttagactctaaaattcaaaaaataatgacaccgtatttagatggtagagaatttcctgatgcagactttgtttttgctacagcagcaacaacggcagggtatgtaaaatctttgccgaatcgttgcgggaaaaaatgctactttatacaagggtttgaaacttggttacttccggaagaagaagttatagagacatttagttacggctttatcaattttactgtatcaaattggttgaatgatcttgtaaagtcctatactagtgatgagactatttgtttaccgaatcccattgatacggaattttttaaggttattaatcctattgaaaatcgtaattctctgtcgttggggatgttgtaccatgaaggcgagcacaaagggataccgtatgctttagaggctattgaaaaagtgaaaaataagtatccagaagtgacagtaaatatttttggtgtacctgaacgcccaaggagtttaccaaggtatttcaattatgttcagaaagcaactcaagaagagttattggaactatataataatacagctatttttgtatgtgctacaatagatgaaggatttggtttgactggtgctgaaagtatggcctgtggctgtgctttggtttcaactgcttacagtggtgtgtttgagtatgcaaaacacgaagtaaatgcattgctttcgccaataaaagatagtcagactctcgcagataatattattcgattaattgaagatcaaaacttacgctattctttggcagatagagctagtcaaatgattgctgaaagatcttggaataatatgattcagagactagaggaaggactaacaaagtaattagatatgaggagcgtaaatgcttaaagtagaaaaattaacgcattatattttttatctcgggttggttataactctgctttcattaacaaatatccagcttccaattcattcgaagtatatcaatcttatcccaaccatattaggattaattccctatattttttatgttagagcaagaaagcttccggatggaacttttcaatcgttgggactagtattcgtttattctataatcatttttttatttcataatcgttttgagattgagtggagcataatcactttattaatttatctccctcttatacgttctgaagagaaggggtttctaaaaggaattataactataaaattgattgtagtttcaatgattgtagcagcaactctaataggagttgtatctgatacaacgctcgtcaaatttaatggggttgcacactctcttggtttttttcatccaaatacattagggacaatatttctatcaatttttcttgatagtattttactattaaaaggaataaaaaaccactatatacttatattttttgggtttttcttatatcttgattatcggattacctactcaagaacatcctttcttgtaatttcttttgcgattcttgtgtttctttttaggaatatactaaaaaaaatagaaattaataagtttctattttcaatgtcaacagtgataatatttttaattggtattttcatttcagttttttataattcagctaatcctttttatattcaattagatgcttttttgagtaaccgaatccgtttaggaagtctgtatatccaaagatatgactttgatatttttccacagtttactcctaatattatacctgctggctggtggagttacgatcaattgtttaacgataatacctacttaaaatttattttatcacaaggaatcttattaacaattttattcctaagttatcttatttttcaaatttatcgcaaaaaattcaccttgtttaacgcaatgctgattatcctgacgtttgctgttttagttactgaagcgcttggatttaatatatttttgtttacaccattgttgttaaattatatgtctatttctaagaatacagagactacttaataaaataatatagaatatggtacaactatgctaaagatttcagtcattgttccaatatataatgtagagaaatatattgaagactgtgttaattctgtaataactcaaacatatacaaactatgagctaattttggtaaatgatgcttctcccgataattccctagaattaataaagaaacttgctgaaaataattcaaaaatacatatcatagataagcagaccaatgaaggtgtatcattggcgcggtcagctgggttacacgcttctacaggtgatatggttttatttttagatggtgatgatactctcatacctacagcattggagatgcttgctcaaaagtataagagatataactcagatattattgtcttctccaaaattcaagaaagagatggtaaactgagagaaacaccttacttttccaaggaaatactttttgatgagaataataagactaagctttatgaagggtttctggactatggttattttgtaattggctatgctgcaatcaacagagaactagctctacagtatgatatggcaaatgagataaagcatatttggataggggaagatcttgttcaaagtttaccactcttaacgtatgctaaaaaagtactgtatattccagagggattgtatgttatgactaataatcctgattctgtgacgaggactaatagtctcagaaaggataggtaccaacaagcaatattgacccataattatatagaagattatcttactaggtgggaaatagcagatctaaatgaaattttttataaacatattatggaggatgcgcttttatatgcttcattaggtgttaaagcaaccaactcaatgtcggatgctagagaatatttgctgactattgctaaggatacacgttttcaagtggcttataggaaaggttatcctcaaaaaattaagaagcgtttaattgcgtttttgttgaaaaataaattatttagattatatttttatttaataaagttaaaatcggggagattgaagtgaaagtctttaaaaattttatttataacttcgtatacaagattctgacaattatacttcccttcataacagtaccttatgtcacacgtatttttgcacctgaagttttgggaaaatataattatacagcttcaatagcaacatattttactatgtttggaatgcttggtattctaatatatggaagtaatcaaattgcgaaaaatgtacataaggggagagaggttttatcagcaactttctcttctatttattacttccagttattgacaactttgatagcaactttgagctttgttttgtatatttttctcttccccagtgcgtacaaaatttttttcttaatacaaatcttctctcttatttcaaatatgatagatattagttggttatttcaaggagttgaagattttaaaagtattgtagttagaaatatttttgttaaattagctagtgtggcattgatttttactcttatcaaaaattctagtgatatttattcttatattctaattatgaccatctcaaatttactctctcaaatgattatatgggccaatatgaataagtatgttaagcttattcgagtgagttggaagagtataattagtcacctaaagccaactatatctttctttttaccacaaatgtctattactctttataatacgatagatagagttattcttggttcttttggaggtgtatatgatgttgggatttatacacaggcaatcaacatcaatactattttaattagtcttgttgcaacattaagtgcagtattgcttcctcgcatgactagtttatatgctcaaggtaaacatgaggaaataagtaatatgatggaatattctatgttattcaatagtttacttacttttccaacggttattggaatgcaattgataaaccatgattttgttcaatggtttttaggagaaggatacggagagacagctatagcaattagtattgtagtttttagtttaattccaatttctttttctgaaatagtgggacgtcagacattgattccaacagataacgtgaagcagtttacgatttcagtcatgattggtgcaatagttagtgtagttttgaattttcaacttataccagttttaggatataaaggtgcagctataactatggttatcgtggagatagtcgtttgtatttgtatggcatattttgctagaactcatatcaatattataaagttattattcatagcaatgaagccattatttaatgctgtattgacagggttattggtttacttaattagtgctaatatgcacttttccaatatgctatattctatactttttaagattgtactattcgtgattatctactctttgttacttatacttacaaagacagttacatctaaagaaatttctgttttaaaacgtaaataaaacatgtaatatactcttgttgattggtgagtatcaagtgcagtcactccataacggagtatattgaaaaacgttccaaagcataaaactctggaacgtttttttatgttgcaacgtaaccgactaataacaaggtgtctaaccaatcactccctcctccagtatactgttataaaaaacaaaactggaggattttttatgtcacactccatcgtcccattgactgttccccaatctcgccgctttgaaaagaaaagcagaaacgatattctgatgaaaattcgtatcggaaaaacggaagtcacattcttccaatctatcaaccctgaagtataatggaaacaatcttggataaggtgctgtattatgaccatccgactcagtgatttaggtcaagtctacttggtttgcggttacttatgtacgaagtagtggtgtgatttgattaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacactttgttctttaagatgatcatcgtttttcacaccggtaaatagataactagaatgactacaatgatgcgctatatagtcttcaagtaacgaaagtatttcatcgtttccaatatagagtagtcgctctttctttccttttccgagtatttgaatggttctattttccaaattgatattatcaagttttaaattacataattcagagatgcgtagaccagttgatataaagtagcgagataaggagtagatttcgcatagctttccgcttagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattgtataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttattatcattagtataccataatctacattttttttatagattttattaaaatttttatagtaaacccgtggtgctagttcatttcaaaatacaataaaaagcccaaatggactatactgtaagtgacgaaacatacaggaggttagtccaaatgagccacttacagtataccgctaaatctcatcatttgcaatggaatgtacgccaattatcacaaatttgtcatcacttctacaacaactattgcccggattccttcaaatatcggcgaaatgttggcttagttaaagtttcagatgaatcaatccttgtcttacttttgttacaagctgaactaggtatgacatcacagcgccatttctacaccatctgccacctcttcccttgcggtcagttactagaaagaagccgtttcaatcgtcggtcaaaacaattgatttggctcgtccaattaatccgaaaagctatgagtgaaatgcttccatctggtaaactagccattatagatagttttcctttgccaacctgttcgcaatcacagagcaaccatttttaaaggattagccgatattggctacaacgcctctaaacatctttggttctacggcttcaaggttcatatgctggtgaccttatctggttttattctgaactatgttgtcacacctgcctctgttcacgatatcaaggcggtttatgaactattagaagggtgtaagcaatcgattatcctaggtgatttaggctacctgagcagtgaactcaagaaggacttagaacaacaaggttaccatctatggacgccgtttcgtaaaaacatgacagggtccgaagaacataacaattggaatgtaatggccatgagacgaactattgaaactcgtttttctgaactgtgtcgtctctttgacatcgaacatacattagctagaagcctagctggactacagttacgaatggaacaaattattctagctcgtaacttacgctattttgaaatgaactagcaccacgggtatagtaaatatttttagttttttgtttcaaaaatgtaatggagattgatttttcacaagtaattgtcataaaaatcagaaaatattttataaatatgataaaataaaagtgatactagtttgaggtaaggatatgaaattaagaagaagcgtagaaaaactaaagggaacgattcgtgtcccaggagataaatcaattagtcatcgctctattatttttggttcccttgcaaaaggtgttactcgtgtccacgatattttgcgtggggaagatgtcttgtcaaccatgcaggtctttcgtgatttgggtgtgaaaattgaagacaacggtgacattgttgaagtacacggtgttggttttgatggtcttcaagcaccaaaaaatgatttggatatgggaaattctggaacctcgattcgtttgatttcaggcgttttggcaggtcaagactttgaggcgactatgtttggtgatgattccttatccaaacgtcctatggaccgagtaactattccactcagtcaaatgggagtagagatttctggacaaactgaacgtgacctacctccgttgaccatcaaagggaataagaatttaaaaccaattcgctaccaactccctgtagcctctgcccaagtaaaatcagctctgatttttgctgccttgcaggctgagggagagtcggtcatcgtagaaaaagagttgactcgaaaccatacagaagatatgattgtccagtttggtggacagttggaagtcaatggcaaggaaatccgcatccaaggtggtcaggagtttattgcccaagagattacagttccaggagatatttcaagtgctgccttttggttggttgctggcttaatcgtaccaggttcaaaaattgtccttgaaaatgtgggaatcaatgaaactcgtactggtattctagatgtcattaaagctatgggcggaaaaatgaccctttctaacatagatgaacttgcaaaatctgctaccattacagttgaaacttcggaattgaaggctacggagattgcaggcgaattgattcctcgtttgattgatgagttgccaattattaccttactagcgactcaagcacatggaacaacgattattcgtgatgctgaggagttgaaagtcaaagaaacggatcgtattcaggtcgttgcagaggctctaaatagtatgggagctactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaatagcacatttgttaaatctccccgtttacgatatggaccacatcattgaagaacggattggtatgcctattgctgactatttcagtcttgaaggagaggcttcgtttagacaactggagacagaggtactgaaagaattgctggacttacctagtaattgtatcgtgtcaactggtggtggggtgattaaatctgaagtaaacagggaattgctgttggcaaatagggaggacaatgtacttcttactgcctcctttgacgtttcctatcagagaattagtaaggatagacagtcgcaaagacctctctttttacagcacagtaaggaagagtttgaaaccctctatagtgaacgaatggcactttatcaaggtttagccgatactgtaatcgatacagataaactgaatccagaacaagtagcaaggaaaattttatgcaagtagcctatctaggacctcgtggttcttttacacatcaagtggcccagcaggcctttccgactgcggatttgcaggcttttgaaacgattacagaggttatcaaggcctacgaaacgggggaagttacctattccgttattccagtagagaactcgattgaaggtagtgttcatgaaacgattgactatctctttcatcaggcggagattcatgcggttgcagagattgttcaaccgattgcccaacaactgttagccacgagtgccgataaggctgtagaggttatctattctcatccgcaggcaattgctcaggggaagaaatatatcaaggaacattttcctcaggctcgtattgaaataacagctagtacagcctatgctgctcgctttgtggcagaacaccctgaacaaccattcgcggcaattgctccgcaagcggcagcagttgaatatggactggaggtaattgcgcaagacatccaggaaatcagcgagaattttacacgtttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccggcccctgaaaacggctttgggtg

SEQ ID NO: 49 - DNA, 30101 bp, Streptococcus suis
atgtgatggaagcatctaagtctgcagcggggtcggcgtgtccaagtccgcaggcttatcaggcagcttttgagggagctgagaacattatcgttgtgacgattacaggtgggctatctggtagttttaatgcggcacgtgtagctagggatacgtatatcgaagagcatccgaatgtcaatatccatttgatagatagtttgtcagccagtggggaaatggatttacttgttgacgaaatcaatcgcttaattggtgtaggactagattttccacaagtagtagaagcgataactcactatcgggaacacagtaagctcctctttgttttagcgaaggttgataatcttgttaagaatggaagactgagcaaattggtaggcactgttgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtagtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagtgtgattcacagagtaacaattttgggatgtaatttccactatagaataatccccctcgtcttttaagttcgagggggattgtttgtatgagactattggatttcattcattcaaatatcttgtgaattgctcccagtttatctgcaaaatcttgttcaaagaagatctgtaagaaatcagctttctgtccgctgaaataataacatttgccaaacatgtgttggatgttaggagaaagaatccccttgcttagctgaaaggtcacgctccctttggaaattcgataggggatgttcaaagcgtatttctctaaacaatcttttattttattccactgagcgtgataaatgtgatgaagatgctgtgtgttccgtgcaaacataccgttatcaatgtagagtgagagagctttttgcatgataagattggtatcgtagtcgattagactcttatgtttgatgaaggtatcacgtagctggttaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataagttgaaccgagagggttgtgcaagcgaggaattgtgtagaaaaacttaatttttccagtctggaagatactttccaattcttctaggtcaattccatctaaatctcgttcaattgtttgataggggattccttgatgtcgaatgagctctatcattcgtgaataggtagggttctctatcaaaatttccgtttttccagccaaggtttccatttgtgtgagaatatatagagcttgttggctaccagctgtgataactagctggtctttttttgtatagacatgatagtccattaacagactttgaacggaggaaatcaattctgccaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgggttgacggatagaaggtaatttctctccacgtttgaatcggtgttcctctattccagtcaaaatatcttggatgataacttgatattttttcatctaggcccccttttttatagactatgttactagctagtatataagaaaaattgaagaaagacaatatatgaatgatggggttgaggttcaggaattaagctactctatggtataattaaatgatgaaaataattatacctaatgcaaaagaagtaaatacaaatctagagaatgcctcgttttatcccctgtctgatcgaagcaagcaggttctggatgccataagtcaatttgatgtaaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgcttagattttcaagggagcttaaagataggcaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcagaaattatcggacattcaagattttaaggtggatggctttgaatattgtgcttccgaatcaacggcaaatcaacttaccttcatacgattagaatatgaaaaaaatagaaaaaaatgaacaagataacattttatgatacagagcatatctagaaaaatcttgatttctatggtataatggacaagttataagtgaaaaggaaggttgtttatgaaaaagagaaacggacggaggaagtcgtccaaactcaaattggtaaattttgcgcttttagggctttacgccattactctatgtttgtttttagtgaccatgtatcgctataacatcctagatttccggtatttaaactatattgtgacgcttttgctagtaggagtggcagtgttgactggattattgatgtggcgtaagaaagcgcgcatatttacagcgctcttacttgttttttcactggtcatcacgtctgttggaatctatggaatgcaagaagttgtaaaattttcaacacgcctaaattcaaattcgacattttcagaatatgaaatgagcatccttgtcccagcaaatagtgatattagggacgttcgtcagcttactagtattcttgctccagccgaatacgaccaagataacatcaccgctttattggatgacatatccaaaatggaatctgctcaactagtaactaatccctcaacatcttatctgacagcatatcaatctatgttgaatggtgagagtcaagcgatggtcttcaacggagtttttaccaatattttagaaaatgaagatccagacttttcttcaaaagtgaaaaaaatatatagtttcaaagtgactcagactgttgaaacagctactgagcaggtgagtggagacagttttaatatctatataagtggtatagatacttatggtccaatttcatctgtttcgcgttcagatgtcaatatcattatgactgtcaatcgtgcgacacataagattttattgacaactactccacgagattcatacgttgctattgcagatggtgggcaaaatcaatacgataaactaacacatgctgggatttatggtgttaacgcctcagtgcacaccctagaaaatctttatggtattgacattagtaagtatatccgactcaactttacttccttcttacagttgattgatttggttggtggtattgatgttgaaaatacccaagaatttacaagtttacatggaaattattattttcctgttggtcaagttcacttaaatgcagagcaagcgctaggttttgttcgggagcgttattcacttgagggaggggataatgatcgcggtcaaaaccaagaaaaagtcatagcagccctcataaaaaaattgagttcaccagataatctagcgaattatcaagctattctaactggtttggaaggatctatccaaacagatttgagcttagaaacgattatgggcttggtaaatacccaattagaatcaggaacacaatttacagtagagtcacaagcattgacaggaataggacgctcagatttatcttcttatgcgatgcctggatcacaactttatatgatggaaattaaccaagatagtctggagcaagcaaaggtagcgattcagtctgtacttgttgaaaaataaagattttaggagaaaatatgaacaatcaagaagtaaatgcaatcgaaattgatgtattgtcattattgaaaacaatttggagaaaaaaattcttcattctcgtgacggcagttttaggtgcaggtttagcatttatctatagtaactttttggtgactccacaatatgattctactactcgtatttatgtagtgagccaaaatgttgaggcgggtgctgggttaacaaaccaagagttacaagcaggtacctatttggtgaaagactataaggaaattatcttatcgcaggatgttctttcacgagtaaagactgaacttaatttatcagatgatttactacaaaaaattaatgttaatatacccgtagatacccgtatcgtttccatcacggttcgtgatgcagatccaaataatgcagcacgacttgctaatagtgtccgtacatttgccgctcagaaaattattgaagtgacgaaagtcagtgatgtaacgactctggaagaggcgatgccggcagaaaaaccggctactccaggcacaacaagaaatattgcaattggtattttagtaggagggatgtcggccgttatattagtgctgatttttgaagttttagatgaccgtgtaaaacgtcctcaggatatcgaagaggtaatgggtttgacattactaggcgtagtgccagattctaagaaattgaaataggggaataatatggcaaagttagaaattgcacgtacaaaaaaaggattggtaaataagacagaaggatattttaatgctattcttactaatattcagctccagcgggtgcagatattaaagtggttggaattacctcagttcaaacaaatgaaggaaagagcacaacggcggctagtcttgctattgcttatgctcgttcaggttataaagaccgtcttggtggatgcggatatccgaaattcagtcatgtctggcttttttaaaccagttaccaagattacaggattaacagattacttggcagggacgacagacttatcacaggggttatgtgatacggatattcctaacttgactgttattgagtcaggaaaaatttcgcccaatccgacagctctcttacagagtaaaaatttcgaaaatttactagcgactcttcgtcgctactatgactacgtcattgttgattgtccaccactaggattagtaattgatgctgccatcattgcacagaggtgtgatgcgatggttttgatagcagaagcaggtagtgttaagcgttcatctttgaaaaaagtaaaagaacagttagaccaaaccgggacaccgttcttgggggtcatcttgaataagtatgatatcatcactgaaaaatatggtgaatatggaaattacgggaattacgggaaaaaagcttgaatttttataatatttgataagtaggtattgagtatgattgatattcattcgcatatcatatttggtgtggatgatggtcccaaaactattgaagaaagcctaagtttgataggcgaagcttatcgtcaaggtgttcgctatatcgtagcgacatctcatagacgaaaagggatgtttgaagctcctgaaaaaatcatcatgacaaattttactcgagtcaaagaggcggctaaagttgcttatccagaaatgaccctatgttatggtgctgaactgtattatagtaaagatgtcttgagaaagcttgaaaaaaagaaagttccaacgcttaacgggtctcgatatatccttttggagtttagtatgcatacaccttggaaagagattcaagaagcagtgaacgaagtgatgctacttggactgattcctgtattggcccatatagagagatatgatgccttagcatttcaatcaaagcgagtagaagagttaattgacaagggatgctatactcaggtaaatagtaaccatgtgctgaagcccgctttaattggtgatcgagcaaaagaatttaaaaaacgcactcgctactttttagaacaagacttggtacattgtgttgcgagtgatatgcataatttaacaactaggccaccttttatgagtgatgcttatagaacaataaaagagagatttggagaagctagagcgaaggctttgatgaaaaagaatcctctcacattattaagaaatcaggcactttgagtgttgattttacgactttagagtatcagttgtcttttggatactgtgagataaattggagagaatatgattgatttaaatagttatcgtcaattacgtttggcgttttttgaactaattgctgtactttttgccgtgtttttgaccagtcaatttccagattcagatcttaatcgtacaggtatattatctatttttgcgctacatttttttgcttttaatctttctaaaatgtatctagatattgagagacgaggatatttagcggaagcagagaagacattggcttatagtctaatttttgtactactattaacctttatatcttttatgttagaagatgaaattgaaatttctagacggggattgatatatttttctgtaattaactttgtactagtttattttttaaattgcattattcgtcattataagaatatatttctaatttcagtggagcaacaaaaaaatactctgcttataactacttacgaacgatttcgatggatgagaagtctgtttgaatcggaattgttgccaactaaatatctagctggagttgtaattttaggagaaggtgcagatgaattgcaaatctcggctccaattattcctttggaggaatcagttgattttgcgactcatgaagtggttgatcatgtttttataaaccttcctagcgaaaattatgatttgaaaggtcttgtctcagaatttgaaattcttggaatagatgtgagtgttgacattaattcatttgattttcaagctttacgaaataaaaagattcaacaaattggtgaccatagcattgttactttctcttcgaatttttataaacctagtcatatatttatgaagcggctgttggatatctgtggctctatattaggtttaattttttgcggatttgtttctattgctttagtacctcttattaggaaagatggcggaccagcaatttttattcaaaagcgtgttgggaaaaatggtcgaatctttaagttttataagttccgttcaatgtacatcgatgctgaggaacgcaaaaaagaccttctgtctcagaatcaaatgcaaggcggcatgtttaaaatggataacgatccaaggattacttcgataggtcagtttattcgtaaaacaagtctggatgaattgccacaattttataatgttttgataggagacatgagtttagttggaacacgtcctccgacagtagatgaatttgaaaaatacactcctagtcaaaaacggcgattgagctttaaaccagggataactggactttggcaagtaagtggcaggagtaatattacggactttgacaagggtgtaaagctagatgtagcttatatcgataattggacgatttggtcagatataaagatactattgaaaactataaaagttgtactattgaatgaaggaagtaagtagaaattagaatgaaaatttgtttggttggctcgtcaggaggacatttaaaacacctatatctattaaagcaattttggaaggaagaagaaagattttgggttacttttgataaagaagatgcacgaagtattttaaaagatgaacagttctatccctgtcattttcctacaaatcgaaatttaataaatcttatacggaatacatttttagcctttagaatattaaaagaaaaaaaacctgatgttatcatatcatcaggtgccgcggtagcagtcccgttcttttatataggaaggttaatgggagttaaaacagtttatatagaggtttttgacaggattgataaagctacgcttacaggtagattggtgtatcccgtaacagataaatttattgtacagtgggaggaaatgaaaaaagtctatccgaaatctatatatttagggagtattttctaatgatttttgtaactgtaggaacacatgaacagcaatttaacagattaattgaagaaattgatcaattaaaaaaagagtgtattattaccgatgaggtatttattcaaactggtttttcaacctatgtaccacaattttgtgattggaaaagcctcctcacctattctgaaatggaatattatatgtctttagctaacatagtgataactcatggggggccggcgacctttatgggagcaattgcaaaaggaaaaaaaaccattgtagtacctaggcaaaaaaagtatggggagcatgttaatgatcatcaaatggaatttgtagagtatgccaaaaagatatacggaaacattgttatcatcaatgatatttcggatattgctactcaattggaatataacgtggatttaaaatcgatagttgtctcaaataatgaacagtttaatcgattattgaggaaagaaatagaaaagctggtgaaatagatgattcctaaaaaaatacactattgttggtttgggggaaatcctttgccagagaatgtgaaacgttgcatagattcttggaaaaagtattgctctgaatatgaaattattgaatggaatgaaaataattatgatgtgaaaaagaatggctatttaagtaaaatgtattcggaaaagaaatatgcttttgtatcagattttgcaagattagatattatctataataatggcggtatctacttggacactgatgtagaattgataaagaatattgacgacttactacaagagcagtgtttcatgggatgtgaattgccgggagaagtcaatacaggagtgggatttggtgcgaataagggattccgcttcttagaagaaaatatggaaaaatatataaatgatgagagcgtttttgataaaacatgtgttgaaattacaacagctattttaaaagataaaggaataagaaaagtggctgatattcaaatgattgataatattactgtttatccacctgaatattttgctccgttaaatatgttgactaacaggttgaaaattacggaaaatacatattctatccatcattatgattctagttggtatgtaggaaacgtgaaatggaaaaaaaaagtattaccttataaaattatactaagaaagattgtagataatatctttggagaaggaacgtattcaagaataaaaatgttgattaggagtaccaatgattaagagtacaaaaggagaattactctacatcacagctttatttatgatagcttttgcaaaaggttttggtctagattcatctagtcttatatataatgcgattttttatgtatctatggtctttatttttttgaaggttatccacgaaagatggatggtagatgaattttatagaatttgcacaattataattttattacttttaaactttttgttcggaaaggatatatcttatcttttttctttcatttatttggtaggaactaaaaatatagatataaataaaattttaaaaactcttttatgggctagagggttgagttttatcagtttacttattgtgaactttttaggacttattaattctagggctattcttttttatcgaaatggctatttcattatgagaagcgatttagggtttggtcatccaaatttggcccagtctagtttttcgatgatagtcttgctattttgttatctatttagaaatagaataaactttttgacttgtattttaatagctgtttttaatcatattttatatcaacaaacattttcgaggactagttattatttaacaattttaattttaatctttttctatcttgaaagaatattgccggaattaataaaaaaaattacagattatgcaaagtatgttcaatttgcacttttagtattgacggtcattttagcaaagtgtatacaattaccgattatacagaagttagatattctttttacaggacgaatctattattcagcgatttcattaaattacgggacaagtctttttggaaagccactctcagcaatacctatattatttgataatagttattcgttaatactatataattcaggcttgctcatgaccgttctacttatgtatagttattataaaacagcaagcaatcatacactaagaaataataagcgaaccttgatattttttatcatgctatcaatactattgttttccgaaagttattatgcaaatgtactctttaatgtaactttattcttctcttttaaagaattagtttggaatggtgtgaatgaggaggggaaaagtaaataatgttgtatatttttacaccagcttacaatagagaaaaatgcttgcgtaggctatatagttcattaatttctcaaacaagtaaagaatttatttggcttgttataaatgatggatctactgataatacagaaaatcttgtgaaaagctggcaaaaggaaaataaaattaagattatttatctttatcagcgtaatcaaggtaagcacattgcctataatacagcattaaaatttatgggagagaaaggttttcatgtatgtgttgacagcgacgataggttatctcaaggtgctgttgagacattcttagaagatatttcagcaatttcagaaaataacttatatattggaattgtttatcccagaaatgataatagaaacgagaacacccaaaagtggatatctactgctatagagacagttaggatccaagatataaagttgaaatatggcttaaatattgaaacttgtattgtaatgaagaatgcttatgtcagttcgtttcgatttccaatttttgaaaatgaaaaattcgttagcgaagaaattatgtatatttacaccggtaaatatggaggttttcgtcccattaacaaagtggtttactattttgaatatttagaggatggtctaaccaagaatatatttcaactatggaaaaaaaatccacagggaacactctattttttagaacaaagaaaacaatatatcaaagaaaattttaatggttttgaaaaatttcgtgaattatgtaaggttaagttgaatatcaacgcttttcgtctgactcagaatgatataaaatggacgaaaggatatagtttaatcgattatttcttgataccgatttcattgtttgtaaaatataggagatttgattagagcaattaattaggtaggacagtaataatataagttcctaagtaccatgagcatacggagagtaaatttgaaatttaacgtgattgattcatcactggtatctgttgttgtaccagtttataatgcagaatcatttcttgcaaaatgcattgaaaatcttagaaaacaaacctataagaatatagaaataatacttgttaatgatggaagtagcgacaagtcagaatctatttgtttagattatgtaaatcgtgatgatagaattcattacgtttataaaaaaaatggaggagcatctacagctcggaataaaggggttttagaatctcgaggggattacattgtattctgtgatgcagatgatatgtattttcctcatgctatagaaactttgttgagtgtgatgcaaaagtatactgctgatatggtaattggaggtatcaccaatgttgaatataaagaggtgcctgagattccagcaaacaaaataattgaaatgggaatagaatcagctttagaagaaatgtactacggtaaattgataggtgtctcagcttctgcaaaactgtataagaaagagttgttggtaaaatatccatataaagaaggtgtaattcatgaagatacatttgcatcatacagacatctatacgagtctagaaataaattggttgtgatagatagtcctatttattttgttaatcaagaaaatgagagtataagtcgttctgcttttaatacaagagatctagtctatgtagatgctatgtacgaaaatttgctttttttacaagaacaaaaatttttacaaaatagaaagatcatgattgcatggagttttatgtatatcatccctatgctaagaattattgataaaatgattaaagcaaattatgagtttgattattcattttatcgaaaagaattttttaagtattcaaaattattgtttttgtcgaaaaaagtgtcgtttaaacataaaattaaatgtttagtatttttattgaatggtactatttatagaaaaagtttaattactttcaaagggagtgactagtagttatgtgtttgataagtgtcatcattccgatttataatgttgaacagtatttagcaaaatgtattgagagtgtctgtcgacaaagctatgaaaatcttgaaataatacttgttaatgatggcagcacggacggttctgaaacgatttgtttggagtatgcgaataacgatgagcgtattcgttactgtaaaaaagaaaatggaggtttgtctgatgctcgtaattttggtattgactgtgctaatggagactatctctcttttgttgactcagatgattatatagagcctacatttatcgagtatttatacaaagctatagagaaggagaaaactgtcgtatcaatgactagctttgatagagtcgatagcgcaggtatttttttaaaagcggaaatacttcctactgatcaatctgttttatcagggagggatgcttgtaaaaagatgttggaggaacatggtaatcgttttgtagtagtatggaataagctttataaaaaagagttatttgattgttatcgttttgaaaatggaaaacttcatgaagatgaatactttacctatcgattactctatgatttagaaaaagtagcaattgttcacgactgtttgtatcactacgttaatcgagaaaatagcatcacaacttctaatatgactgaacatcgcttccgttgtttgattgaatttcagaatgaaagaatgtgcttctataaaaatataggagatggagaggttttactagagtgctattattcgtttttaagatttgcaattgagttttcagataaatataagcagtggatgactgtgaaacaaaagaagtttttacaaaaacaatatcgtaaagtatttatagatatgatgaacagcaatcaagtaagtttggttaagaaattgtattattctgttggctatatcaatctaccgctcatagttattgtaaagctagtattgcatcagttatcttttccaaaatcttactgagcgcaaacgaatctaatattcatgttaaagtataaaaagttttcgataaaataggtgtgtttatatgcaaaattcaaaatatacgagcaaaacaaatgtatacatatgctatacgctctatcatttgttaatttcattaatttatagctctacaatgaatgataaaaagtctaaaattgttatattaacaagaatagcaaatgcggaaacctatcttaaaaaaattcagtactactatccaattatagatgtagtagttgtggatgatgagttgttcaagaaaaaaggtttcttttattctaaggaaattcatcaactctatcagtatgtaatcggagacggattaattcatatctttaatgattggacgcagattggttattatttacatcgtaatagaatttcttatactttgatggaagatgggctaaactgtatgcatcatcctactagcgttccaaaatggacgtttagaactatgattagaaatttcctagaaaacacaccgaactggaatggctatagcccatactgtacttcaatcgttgtaaacgaaataacaggtataccgatggatagtcggtatccaaaatttgtggaagtttccaagaaggaattattgtcacaactctctcatgtggaaaggaaaaagttgttgttggtatttggagggcaaccactagttattaaagaacctgcggtcttaattctgacacaacccttgtttatggaattcccagatgacacaaagaagagagaattttggggaaatttaatacacaaatatagtagcggaggataccatgtttatgttaaagtgcatccaagagatactcttagttatacaatctttccagtgactattttacctaaacatttaccagcagaattacttgattttattgtagacaaacagtttgcaataggtgtaacctactactcgactgcgttggaatatatggactgtgtgcaggaaaaggtatatctttgttgggaaaagtaatatgtttcattaataaacataaaattgtaagaatgagggagaagtgtgtccgtttcaaaattagttaaatcaggttttatttatacactaggtgcggtactgatacaggggctttccttaattactacaccaatttatacccgtatcatttcacaagaggtgtatggtcagtatagtttgtataactcatgggtggctttaataagtctttttattggaatgcagacagttggatcattgcctattgcaaaagtgaaatacgcagatgagtacaatcgttatgttgcccatgcgctttctctatcgactcttgtttttctgactattttttctctagcatttctatttaaatcttatatttctatatatattgaagtttcagagccgatttttttattgatagtgactcaaagttttattgggtatgtagctggatttcttggtcagtactttattcagcttcaacgagctaaggagaatttacttttatctgccatagttgctgtttcttctgtcattttatcactttatttattgcaaattatgcaagatgattttttagcccgcatttatgggggacttttcccagccataggcatggcagtagtaacttatttttatatttatacaagaggacgaaattttgtcagaaaagaatatatacgcttcacattaacaatttcccttcctcttgtatttcatcatctgggaggtcaattactggggcatttgggacgtattatgataggtcagtacatgactagtcgagatgtagcactctatagttttggtagtagtttgggagcaatcattcagttagttcttgggaatattaatatcgcttgggttccttggcactttgaagctaaacgtacaaataatcccgatctttctcgatatgtttttaactttctatctttatctcttttcttaacgttgggctatctaacaatttttcctgaattagcatttttgatgggaggagaaaaatattcagatagtatagaatttattgctctaattatttttagtcattttttgggatttctctatactttccctatgaatattcagttttatcatgggaacactaagtttgttcctgtagcgacacttgtttctggatttttaaatggagctcttaacctctacttcattccgaattatggaaacaaaggtgcagcaatggcaactactatttcctatatgacacttgtggtgtttcactatgcgatttcaaggaaagtatataactataatgaggtatcattacaattttttgttgttttatcagcggtatcaggtggctatgcatacttgatgaacttttttattacgagtctctgtattcgttggtcaattggattcgttgttataattatctacaccctgatcttccgaaaagaacttgaagcaattctctggaaatttaaggagaaaagctgagagtgcaacacttttctctaccaattttataaagtgtttttgttttgcgaatgttttcatggttaggggatgaattaagactgctatgtatgcagaggtagttccaccagtgggcataatccttagtttaaggtgcaattcttccaacgaacagaaaatttcttggttgataaactcaagatcaaagaagcgatagttagtctcagctacggcattgttgggacaattacactaactaagagatttggttcccttgtttcagatgacatagttacttttgaattactcatgaatagccctctttcaattatttatggtgataagggacatgatatatagatcaacaagtgaaatcaaagttatctcaatctggcgttgagttgttatcgcaactaagtaaaaacatgactggctattcgttgcttgacaattatataataagccgtccgagaacgctcatagagattgtattttagagtttatagcagtttggaacctagagcttacattgttgacatttaagagcacttaaagttcggatagcggcgatattgcttgactattctcaatcataatggatttggtatgagtttgaaatattcctgtgcttatgtctaattaactagtacactgaataaaaatatataaaatagataggagaaatttatgattagaagatttttttcaatagataaagtgcaccaatttttacaaaataagtttactgcaaatagagagatccttttggtatgtattttgtatacatttttattcggacttgttactcattcatttatggcgatgaatagttcattttcacatgattctcttccagaattatttgcagctaatgagtggaaactaaaactagggcgtgtttttgctccgatatatatacaagttagaggggagataactttgccatggttgatagtacttcttggactagtatataattcactctctgtatttttgcttacaaaaatttttaatataaaatccagatgcatgatattctttatttcaggaattttaacagtaaatgtgtcttctattgcccttatttcaagttttatccatgagtttgatagctatatgttatctatcttattatcaatattatctgtctatttatggaaacgttatgaaaaagggtatctatatggagcggtttctctcggtttctccattggaatctatcaagcttatatttctgtagccattagtttaatcgtcttttattttttgttagaactgttagaagggaaaaaagtatcgtccctgcttaagagagggataacaagcatagttatgtttgtttttggcggagtgctatattatttagctttaaaagtagcttttttactcacaggtataccagtacgaacaggagcatataattccctagatacgatttttcacatgtcgttcgttgagattctttatacaactgtgagagcctatgtgaatatgataaggaatattatattttacaagtctatagctccaagattgataatgtttgctttacaaattattttatttacatttggggctatttcttttctacaattgcttttaagagaaagagtaaaaactagagaaaaactgctttcatgtttcctagtacttttgttgcctttagtaatgaataccatttttatacttacaaaaggttttgtacacgacttgatgttatttgcgcattggtttgtttatatttttttaattattatatgtagaatggctgtagatagagaaaagcatcatgacttaaaattcttcaatttacaacctgctgttatgatgtttacatttttactgctatggataaatattgtcactggtcattcagtatatctaaaaaaagatttggagcataaagcaagcatttcgctattaactagggttttatatcagatagaaatgcaggataactatgttaccggtgaaactcccgttgtctttgttggagaacctactacactgcttcctaaacaaaacaaattctctcctctatatgaaattgaaggaaatcagaaaacatttattataacaagatggggaaagagatggaaaacacaaagtacatttcattatcttctaaacaaccctatattacttgttgaagaagaacagtggaatgctatgcagaaggattcaactattgaaaaaatgccaatctatccagaaaaaggtagtattgcttttgttggggatgttttggtagtaaaacttggcgagtcacttgataattagatttatctattttgggaatattaagttggagtgatggacaagaagatggtaaagaaaatatatattaatattaaagtcgttggttgaaaggataaaatatgaaaagaatctatatttgtcatacggtctatcaagttttaatctccttattaaagatggatataaaaaatgatacattgctgtctgtgggaattgtaaaaaactttcccaatatgcgtaatgagttgatggcatatgttaatctggtagaggttgaagaatatacatttggactccgttcaatgattcatacattagagacaaaaaattggttttcattttttaaaaatttcgaagaaataattatatttttagatcatcgtcaagtcggacactttttaaataaacataagttgccatattttcttatagaagatggttataactttttcaaagataagagagtttgccatttggagtctatacaatcttcttggaagagaatattatatcgttggtattttcgacctgcaacattaattggttcaagcccttattgtcaatctatagaggtaaacgatttatcgcttgttcatcctgaacaagcttacaaacccttcgtagaagttccgcgtaagaagttattcgatagtatatcgcaggaacgtttggaagcgatagtgcagatatttggagtaaagagtctctttaataatgaagttatcaaagaaaggagagtacttcttttaacacaacccttatcttgggaattttatgtgacagatgaagaacgcttagaaatatatttagctgggctgagaccatattataaggattataagatttatatcaagccacatccaagagatagctttgattattcctcattaggagatggtataattatttttcctcaggatattccaattgagttgtttgaattagctggatatatgaattttgatgtaggaatcacctatagttcctcctcaatggattatttagattgctttgatgaaaaggtttatcttcacgaaaaatttccgctgccttctaaaacaaaaatagattaataaacgttgaataggagcattcatgtctaaaaaatcaatagttgtctctggtttagtgtatacgattggaacaatattaattcaggggttgacttttattaccttacctatctatactcgagtcatttctcaagaagtatatgggcaatttagtttgtataattcttggataggaatcgttagcctctttattggtttgcagctaggaggaactttaggtccaggatgggttcgttatcgagagaaatttgatgattttgtatctacgatagttgtatcttcagttgtctttttcttacctatttgggggctttcctttctactaagtaacccgctatcaaccctgtttggtttgccttcatggattgtaccgctcctctttttacaaagttttatgaatgtcttacaaggtcttttgacaacctatttagttcagatccagcagtccatgctgactttactaatatcggtgcttagtgcagttgtaaacattagtttatccctatttctcattttttctatggaaaatgattttcttgcacgtattatggcaaattccacaacgacaggaatttttgcctgtatatctttaatatatttttataaaaaaatcggaattcattttcagaaagactatcttagatatggtttaactatctctatcccactaatatttcacggtcttgggcacaatgttctaaaccaatttgacaggattatgttagggaggatgttgacactttcagatgttgccctatatagttttggttatacattggcttctatattacaaattgtttttacgagtttgaacacagtttggtgtccatggtattttgaaaaaaagaggaatggagataaagatttactcaagtatgttcactattatctagcagttggactctttgcgactttgggatttttaacaatttatcctgaattagctattttactaggtggagaggaatatcagtcaagtattggctttattccaatgattattgtgggtatattttttgtgtttctatacagtttccctgctaatatccagttctatagtggcaatacaaaatttttacctattgggacacttatagctggattattaaatgtttcaatgaactttgttttaatacctacattgggaatttatggagctgctctaacaactacagcttcctatctattgctcttggccttacattatcgtgttgtaaaaagaaaatatgcttataatgaagtagcagtccctacttttatcaaaatagtaggacttgttgtggtatatactgggctaatgacagcatttgctgtttcaatctggattcgttggactctaggtttatttgttttattgatttatggttatatatatagaaaggaaatttctcttcttctacagaagaaaaaaggtaaataaatggtttatattattgcagaaatcggttgtaatcacaatggtgatgttactttagcacgtaagatggtagatgttgctgttgaatgtggagttgatgcagttaaattccagacatttaaggctgatttattgatttcaaaatatgcacctaaggcagagtatcaaaaaattacgactggggagtctgactcgcaactggagatgacgcgtcgccttgaactgagttttgaggagtatctggatttacgtgactattgtttagagaagggagttgatgttttttcaacaccgtttgatgaagagtcattagatttcctaatcagaacggatatgccagtttacaaaattccatctggcgagcttacaaaccttccttatctggaaaagattggccgtcaaggcaagaaagtaatcctgtcaacggggatggctgtaatggaggaaattcatcaagctgttaagatcttgaaggataacgggacatctgatatttctattttacactgtacaacggagtatccaacgccctaccaagctttgaatcttaatgttcttcacacgttgaagcaagaatttccaaatttgactatcggttattcagatcatagtgttggttcagaagtgccaatcgctgccgcagccatgggagcggaattgattgaaaaacattttacactagataatgagatggaagggccagaccataaagcaagtgcaactccagacatattagcagccttagtaaaaggaatccgcattgttgaacaatctttaggcaagtttgaaaaagagcctgaagaagtcgaagtgagaaacaaaatcgtggctagaaaatccattgttgccaaaaaggctattgataaaggtgaagtctttacagaagaaaacatcactgtaaaacgaccaggaaatgggatttcaccaatggaatggtataatgtcttggggcaggtgagtgaacaagattttgaggaagatcaaaatatcagtcacagtgcctttaaaaatcaaatgtaagtggagacaagatgaagaaaatttgttttgtgacaggttctcgtgcagaatatggtattatgcgtcgcttattaggtttgttgcaggaagattcagaaattgagttgagccttgtagttactgccatgcatcttgaagaaaagtatggtatgacagtcggagatattgaagcggataaacgtagaattgtaaagcgtattccattgaacctagctgacacgtccaagaaaattattgctagatccttggcaaccttgacagagaaattgacggatttgtttgaagaagtgcactatgacttggtaatgattttaggagatcgttatgaaatgcttccagttgccaatgtcgcactcctgtacaatataccaatttgtcatattcacggtggagaaaagaccttggggaattttgatgagtctattcgccatgctattaccaagatgagccatttacatttgacatctaccgaggagttcagaaaccgtgtcatacagttaggggaaaatcctgaatatgtgtataacattggggctatgggtgttgaaaatgtcttgaaacaagagtttctaacaagggacgaactcgctgaagaattaggagtacaattagcggaagaatactacgtagtactctttcatcctgttaccttggagaatgatgtagcagaagagcagacacttgccctactcacagccttagccgaagatgggaagcagtgtttgattattggttcaaattcagacacacatgcggataggattatgaaacgaatgtacgaatttgttactgaacatccaacgtctcatattttttcttcccttccaactcgttattatcattctttggtcaaatactcaaatggcttgattggtaattcctcatctggcttgattgaagttccctcattgcaggttccaactttgaacattggaaatcgtcaattgggtcgtctatcaggtccaagtgtggtgcatgtcgggaccagtaaagaagaggttggtatgggattaaagcagataaaagcagtaaccgattttacaaatccgtttgagcaaccagactcagcacagcaagcctatcaagcaatcaaagcattcttagcgatagaatcatccaccatgaaagaatttcatgatagataagtgaggtcgattgatgaaaaaagttgcgtttttgggagcagggaccttttcagacggggttcttccttggctagatagcagactctatgagctagttggttattttgatgacaaaccgatagaatgctatcgaggctatccagtatttggacgattgcacgatgttatagattatttagacactggcaagattgatgcggtctttgtgacgattggtgataatgtcaaacgtaaggaaattttcgaactgattgccaaggaacactataatgccctatttaacatcattagtgagcaagcacatattttttctccagatagtattaaggggagaggaattttcttaggtttttcaagctttgttggagcggattcctatgtgtatgacaattgtatcatcaatactggagcaattatcgaacaccatacaacggttgaagcacactgtaatattaccccaggagtgacagtgaatggcttgtgtcatatagggacagggacttatataggaagtgggtcaacggttattcaatgcattgagattgcaccgtatacaacattgggtgctggaacagtggtattaaaatcgttaacagagtcaggaacctatgttggtattcctgctagaaagataaagtagggtgggttgatggaaccgatatgtttaataccggctcgttccggttcaaaaggattgccaaataaaaatatgttatttttagatggtgtaccaatgatttttcatacgattcgggctgcgattgaatctggctgttttaaaaaggaaaatatatacgttagtacagattcgcaaatttataaggagatttgtgaaacgacaggggttcaggtgttgatgcgaccggctgagttagcaacagattatacaacatctttccagttgaatgaacattttttacaagatttttcagatgaacaggtttttgtactcttgcaagtaacctcaccattaagaactggcaagcatgtaagagaagcgatagaattatatgatttaggtcaagcagatcatgttgttagttttacaaaagttgacaagtcaccaactttatttacaagcttggatgaatttggttttgctaaagatattgcaggactaggtggcagttaccgtcgccaaaatgaaaagacgctctattatccgaacggcgcaatttatatttcttctaaagcagtttacctgcatgatcaaacttatttttctgaaaagacagtagcttatatcatgaataaggaagattcaattgatgtggatgatcgatttgattttactggtgttattggtcgaatgtattttgactatcaacgtagagagcagcaaaataaaatattttatcaaaaggagttaaagcgtctatgtagtcagctaacaaatgataaacttatcataggagatagtcgcctgctatcattgacacttgatggttttgataatatcagcattggcggaatgactgcagcgacagcattggaaaatcagcatctttttctaaaaaagccaatgaaacaagttgtgctttccttaggtgttaatgatttgatcacgtcctatcctatttatgtaattcaggagaatatccgacagctgatggagttgcttgtgagcagggttgataaggtttttgtgacaacaattgcctacacactttttcgtgaaagtgtttcaaatgatgatattatccaattgaatcagtatgttcgtaaattggcaactgaacatggcatctctatcattgatattaatgaagtagttgccaaggatgacctacttgactatcagtatacgaacgacggtctacatctcaataagcgtggacaagggcgtgtgaaccaactaatttgtcaagccgtggtcgaagaaaactagatagaatcattgaacatataaaataatgttaatgctatgagaaatctagagatccaattttctctcctatgaattttgaacttatattcgcataggttaatttgactctgtttggcataatatcctgtgtgtgataccaattgagtagagatgttggataggaaagttaaatgtaaaaacaatatgaaaaatacgattatctagttgttggtgcaggtctgttcggagtggtctttgctcatgaggcagctaaaaagggtaaaaaaaataaaggttatcgaaaaacgagaccacattgcaggtaacatctataccaaagaagtagaaggtattcaagtccatgaatatggcgcgcatattttccatacttctgaaaaagaaatttgggattatgtgaatcagtttgcggagttcaaccgctatacaaacacaccagtcgctaactacaagggtgggatttacaatcttcccttcaacatgaataccttttacaagctttggggcgtggtgactcctgctgaagctgaagcgaagattgcagagcaacgagctgtattgggaggaaaaacacctgagaacttggaagagcaagccatctcactagttggtacagacatctatgaaaaattgatcaagtcatacaccgagaaacaatgggaaaagccgtgtagggagttacctgccttcatcatccgtcgtttgcccgtgcgtttgacttatgataataactactttaacgatacttatcaaggtattccaatcggcggttatacgcagattgtagaaaaaatgttggaacatgaaaatatcgatgtggagacaaatgttgatttctttgccaataaggaagactatttagcgacctatccgaagattgtatttacaggaatgattgacgagttttttgattaccaacttggtgaattggaatatcgtagccttcaatttgagacagaagtattggatatggaaaactatcaaggaaatgcggttgtcaactacacagatagtgaaacgccatatactcgtatcatcgaacacaaacatttcgaatttggtacacaaccgaaaaccattattacccgtgagtactcgaagacctggaaacgaggcgatgagccatactatccagtcaataatgaccgcaacaacaaactctatactgcttataaacgcctcgcagaacaacaagagaatgttatattcggcgggcgtcttggtcattatcgttactacgatatgcaccaagtcatcggagctgccttacagtgtgtgagaaatgaagttggggaatgattttgagaagtcatcaaagtagtaattgattcttggcagaagttggaatgctctcaaaatgttaatcaaaaaaaccagaaattctgttttttttgatcccacgttgtaaaatgaagtgcaacaaaaaagacatgttcgtctgatatactggaattcctcaactcagtatagaaagcagatgaacatgtccaacactcattctaccagaaactcatcctattctcatctctcagccacagaacgtggtgaaattgttgcttatcttaaaatgggaaagaaaccaattgaaatcgctcggcttctggggcgtcaccggtctacaatctgtcgagaaatcaaacgtggttcagtagatcaggtacaggataagaatgggaaacgaacttatttcagcgcctatttcgctgatagtggacaacgtgtctatgaaaccaatcgtcaaaagtgttcttatctcaagttgaatgattgctccgctaggttcattgaacaattaggagatgccttgaaagctaacattcttctccttagcgtagatagttttgttcagacttataaagcaagccatcctgaagaagtcgtgccctctaccagaacgatttatcgttatatcaaagagggactgttagctattaaaccaatcgatctgcctaagatggttagtatcagaaaacgttctaagaaagtcacgaagacgaatcggaagactttaggtaagtctatcgaagaacgtccagagtgtatcaatgaccgttctgaatctggtcattgggagattgatttagttcttggcaagaaaacccaaaggtgaagcagttattttgaccttggtagagcgccagacacgctatgcactggcactgggtgttaagttagaagacaaacagtcccacaccattaatagtgctgtaagccatctccccagtctgtatcctattgcatccatcacagcagataatggtgctgagtttagtttactctcagacttggaagccgttgatgtttactttgcacatccttattcttcacatgagagaggcacaaacgagaacttcaatggtctcctcagaagaatatgtccctaaaggagtctcacttaattcactaacttctgaagaactagaaagttatatcactgccatcaatgagcgccccagaacgacttcttcaataccaatcctcaaaatttctgtttgggctagcccaaacagcttaacctatggaactctagttatcaatgaacttgttgcacttgacttgacaacgtgagatctttcaaaaaatggtattttcatttttccatcgttccatcaggcgacggttatcaattgtcaaatgtttgccttttggtgtataatgtttttgtatctctgtgcctctttcttgtgtttgtggtgaacaacaagtatagcacagaggtgttttctggctctttgtcaactgtagtgggtagacgaaaagctaacacctagagaggacgaaattcgttctctcatttttgatgttcaaagcaatatatatcttagttttaaagttcgtaaagttcctaaagccgaacgcttgcctcttgatgtctttgatgagtttattggttgcttccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaacttcaatgtcttctggacaacctctctcggtgttactgtttgcccaaaagtgcgagaaaagaagcgattcagagacagttttcgactatctttttggagaatacgccagtgatttttcatggatcgataaggtaggggatgcgtatcgaaagtcttcataatatcaattctagtcgtcatcatagcacggctcaggtgttggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtggtttggcggttgttgtcaagaatggtcacaatcgatctcgtttcaaaattctgagcaataaaggcgagttttcccttgttccgactaaattcatcccaactcaagacttttggtaatttcgtaaaatcatgctcaaattgaaactgagccagtttcctctggacgaccgatacggagatatgtaatctcctagcgatggctatattagtcatgttttctgtatggagttgtgtgactttctcccaaataggtagggaaatctgacagtttttcttgactagagctgtctcagctacagtcactttttggcaagatttgcattgaaaccggcgtttcttaagcaagaggagggtcggaaagccctgacaatccaaaatcggaatctttgacgacttttgaaagtggtacttgatacactttccttggcaatgaggacaaccagggctgtcgtaatctagctttgccctgatttctagatgggtctgatgtttcaaaatgaagagaattttgatgtttttgtctttgattccaattagttctgtggtatgataaagttgttccatatgagtctttctaatgtgagtgtggttgcttttcattataggtcatatgggactttttgtatatactcaaaaaggctccataatctctatagtggatttacccactacagaaattatagagccgaaactgttttgtcagctaaaccaaggttactattagcattggctacttagtctaacagcttcaaacctgttatcaaatgaaattaccggcttactcaaagatagtgaaacaagtatttttgggtaaggcgaggtggctaactttattatagaactttcaaaatgtaatggaaattgattttttgcaagtcattgtcataaaaatcagaaaatatttaataaatatgatagaatggaggtaatactagtttgaggtaaggatatgaaattaagaagaagcgtagaaaaactacagggtgtgattcgtgtcccaggtgataaatcaatcagtcatcgttctattatttttggttcccttgcaaaaggtgttacccgtgtccatgatattttgcgtggggaagatgtcttgtcaaccatgcaggtctttcgtgatttgggtgtgaaaattgaagacaatggtgatattgttgaagtacacggtgttggctttgatggtcttcaagtaccaaaaaatgatttggatatgggaaattctggaacctcgattcgtttgatttcaggcgttttagcaggtcaagattttgaggcgactatgtttggtgatgattccttatccaaacgtcctatggatcgagtgactattccactcagtcaaatgggagtagagatttctggacaaactgaacgtgatctacctccgttgaccatcaaagggaataagaatttaaaaccaattcgctaccaattgcctgtagcctctgcccaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagtccaggagaatcagcccgt

SEQ ID NO: 50 - DNA, 46639 bp, Streptococcus suis
ggacttttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcataccatttctttttaaggttgctggaagtccgttcgtagtagtcttcaaggatttcttccttggacttgtaattgcggtagaatgcgttgcgtgacacaccagcttttcggaccaattcagatactgaaatttgcttgagctcctttttctctaggagaaatagcagagcagtttctattgattccttagtcagttgattcgcttctttatttgattgatagaggtttttcaaagattggggtgaaattttacgacctgtcatagttttccttttccgagtgtcacatctgaaagaaaatgctttcagatggggtagtttaatgatataattgtaagtaaatagagatttattgtcaaataaaaaagtaaaattggaaatgagaatattatgacaaaatggaaaattgttgcagattcgggctgtgactatcgtcaattagctaatctagctccgaacactgaatttattagtgtgccacttaccatccaagttggagaacaagcatttgttgatgatgcaagcttggatattgatcacatgatggaggtgatggaagcatctaagtctgcagcggggtctgcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcattatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaatactcaatgaaaatcaacagtagcctaggaaacgaagtcgaagatagaactctgttactatcttatttcaaggtaacaggctgaaaacctccactggagcttttcactcatcaaggcaagttgacaacggataattttgattttcgaagagtataacaattttggaatgtagtttccactatatagaataatccccctcgtctcttaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggagaaagaatccccttgcttagctgaaaggtcacgctccctttggaaattcgatacgggatgttcaaagcgtatttctctaaacaatcttttattttattccactgagcgtgataaatatgatgaagatgctgtgtgttccgtgcaaacataccgttatcaatgtagagcgagagagctttttgcatgataagattggtatcgtagtcgattagactcttatgtttgatgaaggaatcacgtagctgattaggaaggctgattgcaccgattcggagggcaggaaagagtgtcggtgtaaaagattttatgtagatgacacgattatctgtatcaagatagtgtaaaggtaggctatgactagagtcgaaatccgccaaatagtcatcctcaatgatgtagacatcgtattgctttgctaattttacgatggctgtttttgttgctatatcataagttgaaccgagaggattgtgcaagcgaggaattgtgtagaaaaacttgatttttccagtttggaagatactttccaattcttctaggtcaattccatctaaatcccgttcaattgtttgataggggattccttgatgtcgaatgagctctatcattcgtgaataggtagggttctctatcaagatttccgtttttccagcccaggtttccatttgtgtgagaatatatagagcttgttgactaccagctgtgataaccagctggtctttttttgtatagacatgatagtccattaacagactttgaacggaggaaatcaattctgctaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtactttaattccaacatagccttttggacagtgtctttgctacaatgatattgctcactgagttgacggatagaaggtaatttctctccacgtttgaatcggtgttcctctattccagtcaaaatatcttggataataacttgatattttttcatctaggccccctttttatagactatgttactagctagtatataggaaaaattgaagaaagacaatatctggatggggttgaggttcaggaattaagctactatatggtataattaagtgatgaaaataattatacctaatgcaaaagaagtaaatacaaatttagagaatgcctcgttttatcccctgcctgatcgaagtaagccggtactggatgccataagtcaatttgatgtaaaaaagctggctgccttttataaattgaatgaatcaaaggctgagttagaagctgatcgttggcatcgaatcaggacaggtcaagcaaaaaactatccagcctggcagttatatgatggtctcatgtatcgttatatggataggcgaggtatagattcgaaagaagaaaattacctacgtgaccatgttcgtgtagcgacagccttatacggattgattcatccttttgagttcatttcacctcaccgcttagattttcaagggagcttaaagataggcaatcagtctttgaaacagtactggcgaccgtattatgaccaagaagttggtgatgatgaactgattttctcactggcttcgtcagaatttgagcaggtgttttctccacagattcagaaaagattagttaaaattcttttcgtggaagaaaaagcaggtcagctaaaagttcactcgactatatcaaaaaaaggtagaggaagattgctgtcctggttggctaagaacaatattcagaaattatcggacattcaaggttttaaggtggatggctttgaatattgtactgaaaaatcaacagagaatcagctgactttcatacgttcagttaaattatgaaaaaagaacaagataatgtttttcaggttttcaggtaacgtttttcatcactaaatatagctatgtcgctagtaaaagattgttatttgtgatacaataagtaagttataagtaaaaggaaggttgtttatgaagaagagaagcaggtggaggaaatcgcctaagctcaagttggtaaattttgtgctttggggactttatgccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcattcttacttattttttcactagtcatcacttccgtcggaatctatggaatgcaagaagttgtaaaattttcaacacggctaaattcaaattcgacattttcagaatatgaaatgagcatccttgtcccagcaaatagtgatattacagacgttcgtcagcttactagtattcttgctccagccgaatacgaccaagataacatcactgctttattggatgacatatccaaaatggaatctactcaactagcaactagccccgcaacctcttacctgacagcatatcaatctatgataaatggtgagagtcaagcgatggtcttcaacggagtttttaccaatattttagaaaatgaggatccagacttctcttcaaaagtgaggaaaatatatagttttaaggtgactcagactgttgatacagctactaagcaggtgagtggagacagttttaatatctatattagtggtattgatacctacggtccaatttcatctgtttcgcgttccgatgtcaatatcattatgactgttaatcgtgcgacacataagattttattgacaactactccacgagattcatacgttgctatcgcagatggcgggcaaaatcaatacgacaaattaactcatgctggtatttatggtgtcaatgcctctgttcatacattagaaaatctttatggtatcgatatcagtaattatatccgtctcaactttacatccttcttgcagttgattgatttagttggtgggattgatgttgaaaatacccaagaatttacaagcggagggtataatttccctgtggggacagtacacctagacgcagagcaagcgctaatctttgttcgtgagcggtattcgttggctaatggtgataatgaccgtggtaaaaaccaagaaaaagtcattgcagccctcataaaaaaattgagttcaccagagaatttacgcaattatcaagctattttaaatagtttagaagattctattcaaacggatataagtattgaaacaattataggcttagtgaatacgcaattagaatcaggaacacaatttacagtggagtcacaagcgctagttggaaatggtcgaacagacttgccttcttatgccatgccggattcacaactttatatgatggaaattaaccaagatagtctggagcaagcaaaggcctcgattcagtcagtattggatggaaattaaaaaaataggagaaaacatgaataatcaagaaatgaatacaatcgaaattgatattttactcttactgaaaacgatttggagaaaaaaattctttatccttctgatgggactattaggtgcagggttagcttttgcttatagtagttttttggtaacaccgcaatataaatcgacaactcgtatctatgtagtcgggcaacatgctgaagccggtgcgggattaacaaatcaggatttacaagctggttcttatttggtaaaagactataaagaaatcattctatcacaagatgtactgacgcagatagctacagagttgaatttgaatgaaaacctaaaagaaaaggtttcggtttctattcctgttgatactcgtatcgtttctatttccgtgcgtgatgcggatccaaatgaggcagcacgtattgcaaatagccttcgtacctttgcagcgcaaaagattgttgaggtcaccaaagtgagtgaagtgacaacactcgaggaggctgtcccagcagaggagccatcaactcctaatacaaaacgaaatatcatacttggtttattagctggtggtatcttggcaacagctcttgtactggttatggaaattttggatgatcgtgtaaaacgtcctcaggatatcgaagaggtaatgggattgacattacttggtgtagtgccagattcgaagaaattgaaataggagaacaatatggcaacgttagaaattgcacgtacgaagaaagaattagtaaataagacagaagaatattttaacgctatccgtacgaatattcaactcagtggggaagatattaaagtggttggtataacttctgtccaattaaatgaaggaaagagtacaatagcagccagtcttgctattgcctatgctcgttctggctacaagacagttctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttctacaaagtaagaattttgagaacttattagctactcttcgtcggtattttgactatgtggttgtagattgtccacctctagggatggtaattgatgctgcaattattgctcagaagtgtgatgcaatggttttagtagcaggggcaggacatgttaaacgttcagctgtgaaaaaagtaaaggaacagttggagcaaacaggaacacagtttttaggcgttatcttgaacaagtatgatattgcaactgagaaatatggtgattatggaaattatggtaattacggtaaaaaagcttgatttttatgatatgagctttgattaagtaggtgttagtatgattgatgttcattcgcatattatatttggtgtggatgatggtccaaagacaattgaagagagcctgagtttgataggcgaagcttatcgtcaaggtgttcgctatatcgtggcgacatctcatagacgaaaagggatgtttgaaacaccagaaaaagttatcatgactaactttcttcaacttaaagcagcagtagcagaagtttatcctgaaatacgattgtgctatggtgctgaattgtattatagtaaagatatcttaagcaaacttgaaaaaaagaaagtacccacacttaatggctcgcgctatattctcttggagttcagtatgaatactccctggaaagagattcaagaagcagtgaacgaagtgacgctacttgggctaactcccgtacttgcccatatagaacgatatgatgcactagcgtttcatgcagagagagtagaagagctaattgacaagggatgctatactcaggtaaatagtaaccatgtgctgaagcccgctttaattggcgatcgagcaaaagaatttaaaaaacgcactcggtattttttagagcaggatttagtacattgtgttgctagcgatatgcataatttatctagtagacctccgtttatgagggaggcttataagttactaacagaggaatttggtaaagataaagcgaaagcgttgctaaaaaagaatcctcttatgctattaaaaaaccaggcgatttaaactggttactctagattgtggagaaaaaatggatttaggaactgttactgacaaactgttagagcgcaacagtaaacgattgatactcatgtgcatggatacgtgtcttcttatagtttccatgattttgagcaggctgtttttggatgttattattgatattccagatgaacgctttattcttgcagttttatttgttttaatattctacctgattatctcagttagactaaaggttttttcgttaattacgaggtatactggatatcaaagttatgtgaaaataggactgagtttgatatctgcgcattcattgtttttaattatctcaatggtgttgttgcaggcttttagctatcgtttcatcctggtgtccttatttttgtcatttgtaatgctcattaccccaaggattgtttggaaagtcttacatgagacgagaaaaaatgccattcgaaagaaggatagcccactaagaatcttagtagtaggtgctggagatggtgggaatacttttatcaataccgtcgaagatagaaaattggattttgaaattgtcggtattgttgatcgtgatccaaataaacttggaacatttatccgtaccgctaaagttttaggaaaccgtaatgatattccacgattggtagaggaattagctgttgaccaagtgacgattgccatcccttctttaaatggtaaggagcgagagaagattgttgaaatctgtaacactacaggagtgaccgtcaataatatgccgagcattgaagacattatggcggggaacatgtctgtcagtgcctttcaggaaattgacgtagcagaccttcttggtcgaccagaggttgttttggaacaggatgaattgaatcagtttttcaaagggaaaacaatccttgtcacaggagcaggtggctctatcggttcagagttatgtcgtcaaattgctaagtttacgcctaaacgcttgttgttgcttggacatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatacaatccacatgaagcagtgaagaataatatttttggaacgaagaatgtggctgaggcggctaaaactgcaaaggttgccaaatttgttatggtttcaacagataaagctgttaatccgccaaatgtcatgggagcgactaaacgtgttgcagaaatgattgttacaggtttaaacgagcccggtcagactcaatttgcggcagtccgttttgggaatgttctaggtagtcgtggaagtgttgttccgctcttcaaagagcaaattagaaaaggtggtcctgttacggtcaccgactttaggatgactcgttatttcatgacgattcctgaggcaagtcgtttggttatacaagctggacatttggcaaaaggtggagaaatctttgtcttggatatgggcgagccagtacaaatcctggaattggcaagaaaagttatcttgttaagtggacacacagaggaagaaatcgggattgtagaatctggaatcagaccaggcgagaaactctacgaggaattgttatcaacagaagaacgtgtcagcgaacagattcatgaaaaaatatttgtgggtcgcgttacaaataagcagtcggacattgtcaattcatttatcaatggattactccaaaaagatagaaatgaattaaaagatatgttgattgaatttgcaaaacaagaataagaaagtaaaagctatttttactttcctagagtctaaataggatttagattctaggaaggttgaaatactttcctgaggtaaaatatgctaggtcataggttattaagagagaaagaaaacagaacgaaaggtggtctctatcataaggttcagatcgagctggctttcaactcaaaccacatcgaaggcagtcaactaactcatgaccagacacggtatatctatgagatcaataccattggttttgaggacaatccaaccataagggtggatgatattatcgaaaccactaatcattttactgctttcgattttctcttggatagttttcaagagaaattgaacgaaaaatgggtaaaggatatccatgctatattgaagagaggaacttctgattcacggaagtcatggtttcaagtaggagattataagagatttccgaatgaagttggcggtcaagacacaagcctacctgaacatgtggagtcggacatgcaagaactgctgaatagctatcacagcttacctgaaacttcctttgaggatattcttgattttcatgttcaatttgaacgcatccatcccttccaagatggtaacggtcgagtgggtcgattgattatgttcaaagaatgtctcaaacatggacatgtcccctttatcattggtgatgatatgaagtatttttactatcgtggcttagccgaatggggagaacagaatggtttcttgcgggacacttgtctagcagcacaagatagatttaagcagtatttggattattttaggattgaggattagtggtaacttgcaattaggagaatgaatgcatagcggaagaactataacaaaagaatatctaaaagcgaatgaaataacaggtcagtattttgataaaattgaaacaagaaagtttgaattatttttaaaatacactacagataagttgttagcactaatcctattagtattactttcgccagtcatcattgctttatctatttggataaaactagacagtaagggacccgttttttaccgtcaagaaagagttacaagatatggtcgaatttttagaatatttaagtttagaacgatgatttctgatgcggataaagtcggaagtcttgtcacagtcggtcaagataatcgtattacgaaagtcggtcatattattagaaaatataggttggatgaactacctcaactgtttaatgttttgactggtgatatgagctttgttggtgtgagaccagaagtgcaaaactacgtagatcagtacactgatgagatgcttgcaaccttacttttacctgccggaattacttcaccagcaagtatagcatataaggatgaagacattgttttggaaaaatattgttctcagggctatagtccagatgaagcctatgttcaaaaagtgttaccagaaaaaatgaaatacaatttggaatatatcagaaactttggaattatttctgattttaaagtaatgattgatacagtattaaaagtgataaaataggagattgatatgacaaagagacaaaatattccgttttcgccaccagatattacccaagctgaaattgatgaagttattgacacactaaaatctggttggattacaacaggaccaaagacaaaagagctagaacgtcgactatctgtatttacaggaaccaataaaacggtgtgcttaaactctgctactgctggattagaactagtcttacgagttcttggtgttgggccgggggacgaagttgttgttcctgctatgacctatactgcctcatgtagtgtcattactcatgtaggagcaactcctgtgatggttgatattcaaaaaaacagctttgaaatggattatgatgctttggaaaaagcgattactccgaaaacaaaagttatcattcctgttgatctagctggtattccttgtgattatgataagatttataccatcgtagaaaacaaacgctctttgtatgttgcttctgataataaatggcagaaacttttcgggcgagttattatcctatctgatagtgcacactcactaggtgctagttataaggggaaaccagcgggttccctagcagattttacctcattttcttttcatgcagttaagaattttacaactgctgaaggaggtagtgtgacatggagatcacatcctgatttggatgatgaagagatgtataaagagtttcagatttactctcttcatggtcagacaaaggatgcactagctaagacacagttaggttcttgggaatatgatattgttattcccggttacaagtgtaatatgacagatattatggccggtattggtttggtacaattggaacgttacccatctttattgaatcgtcgcagagaaatcattgagaaatacaatgcaggctttgaggggactttgattaggccgttggtacacctgacggaagataaacaatcgtctatgcacttgtatatcacacatctggaaggctttactttggaacaacgaaatgaagtcattcaaaaaatggctgaagcagggattgcttgcaatgttcactacaaaccattacctcttctcacagcctacaagaatcttggttttgaaatgaaagattttccgaatgcctatcagtattttgaaaatgaggttacacttcctcttcataccaacttgagtgatgaagatgtggagtatgtgattggtacaattaatagtgttagttctgagtttgaaagtgagaaacattgaaaaaagactatcaaataatattaaatccaaatgaaaatgaaattaataaagtagttgaaatacatttatcaacgtttaaaggtttgttcttaacatttttaggtagaggttttttaaaaaatttgtatgcaggttttttagaacataatttttcagaacttatgttaataactactaataatgatgttattggttttattgcatattctgaaaatattagtgcattttacaagtggttattaaaaaataagttttttcagtttttatggtatagtttcttggccagtatacgaagtcctaaagcaagtattcgattgcttagggctttgttctatcctcaaaaaagtcgaagtaacgaaagctacgttgaactctcttcgataggaattcatcctaactataagaatcaagggtttgggagcgccctcatatccgagttcattaaacgacaaaatttttcagaaattgactatataaagttaacaacagactcaattgacaatgatttagccaataccttttataaaaaaaatggttttaagttgtattccacctttactactcctgaaggcagaaaaatgaatgaatatcgttattatgaggaaaagatatgaaaaaggcgttaataatttcaactgtaagtagacagttttatctttttgagcaagtgaatattaaagttttgagagagcttggttatgaaattcacggtgcggcaaacttttcagatagaaatgaacgattgaaagaagtgaatattattgaacataatgtaaatttttctaggaatcctctatctattcgtaatttttttgcatttaaaaaactatttttaattttgcgtgagaataattttgatttaattcatgctcattcaccagtcggcggagtttatgggagactggctgccaaattatgtaatgttccccagataatttatactgcccacggttttcatttttttaaaggagctccgaaacgaaactggttactatattatccgattgagaagattttgtcctatttaactgataaggtgattgttatcaatgaggaagattataaattagcaaaaagtaaatttaggtctaataaaataaactttgtatcaggagttggagtcgattactctaaattcagacctatatcaattgaaaaaaaggttgaaaagaggagacaactcggctttactaaaaacgattgtattttaatatacgtcggagaattaagtcaaagaaaaaatcaaagtgtattaattgatgcaatggcagatattgtaaaaaaaaatccgaaggttactttactattggtggggcaaggaaaactcttttcaaaatatcaagaaagaataaatagtttgaatttacaaaaaaatgtacatttgctagggtaccgtaatgacatcgttgatttaatgcaaatagccgatatcgcaatatctagttctctgcaagaagggttgccggttaacttgatggaggctatgggagttgctcttcctttaattgtttcgaattgtcggggtaatcgagatttagtcaacgataacggaataataatatatagaaatactgtgaaagagtgggaaaaatcaataatatctcttttgaattcaccttctaaaatgaaagaattcggtttgaatagtttgaatcaagcgaccaatttttcggaagaacaaattagaaagaaaatgaaagaaatatacaatgactacccgtggtgctagttcatttcaaaatagcgtaagttatgagctagaataatttgttccattcgtaactgtagtccggctagccctctagctaatgtatgttctatgtcaaagagacgacacagttcagaaaaacgtgtttcaatagttcgtctcaaggccatcactttccaattgttatgctcttcagcccctgtcatgtttttacgaaatggtgtccatagatggtatccttgttgttctaagtccttcttgagttcactgctcaggtagcctaaatcacctaggataaccgattgcttacacccttctaataattcataaaccaccttgatgtcatgaacagaggctggcgtgacaacatagttcaaaatataaccagataaggtcaccagcatatgaaccttgaagccgtagaaccaaagatgtttagaggcgttataaccaatatcggctaatcctttaaaaatggtaactctgtgattacgaacaggttgacagagtagcaaaggaaaactatctataatagcgactctatcagatggaagcatatcactcatagcttttcggattaattggactagccaaatcaattgtttagaccgacgattgaaacgacttctttctagtaactgaccacaaggaaagaggtggcagatactgtagaaatggcgctgcgatgttatgcctagttcagcctgtaacaagagcaagacaaggattgattcatctgaaactttgactaagccaacatttcgccgatgtttaaaggaatctgggcaatagttttggtagaagtgatgagaaatttgtgttaactggcgtacattccattgcaaatgatgagatttagcagtatactgtaagtggctcatttggactaacctcctgtatgtttcgtcacttacagtatagtccatttggactttttattgtagtttgaaatgaactagcaccacgggtaatgactagttttttctattaagagttaggaattttaagatggatgagaagaagcaaaagaagatatctttttttattggtggtatgacccgtggcggagcagaacgtgtcatttctatccttgctaatcattataatgaattaggttgggatgttgacattgtactactcttacaagataatgttgattataaacttaatgctaatataaatattgttagtatggttagaaagggaaactatgtcaaagcagctccaaaatggcttttagatattcgtaaatatctgaaaaaaagaaaaccagacagaatagtttcctttgtggggcgaattaatattcttgttttgacagctaaatttggattaaaaataaagactattatctcggagagaaatgatccaaggcacgatggacgcgggaaattaattacagcatatggcaatttgatttatagaacagccgactgcatcgtttatcaaacacaatatgaaaaatcttgttttcctaagaatttagaaaagaaaagtaggattatcgtaaatcctgtttcagttaagacgcaggcacatgatacacagaaacactgtgtggtaacagcgggtagactgttgcctcaaaagaatcaagcattattaatagatgctgtttcaaaacttaagagcaaatatcaggatatacatcttacaatctatggggaaggaaacttaaaagaacagcttgaatcacaagtaaaaagactcggtctcgaagataatgttactctcccgggaaatgttcaagacctacatgaacgaattgcttctgctgaaatatttgtaatgacttctgagtttgaagggctgtcaaatgctctgattgaagcgatgatgatagggcttccttgcataacaacagattattctggatcagacgaagtaataaaagatggctataatggattggtaacaccacgcaataacgtaaaagctatgtcggaggccattgaaaaattgtttacgaatactgattttaaaaatgagattttagtaaattcaaaaactgaaagcaagagatatatgagtgaagaagttttgaaaaagtgggatagcgtaatttcgaatatttaaagaatccataaaaagacaaactataagaaaggtcaatagtttcgtctgaactatttttgtttcaaatgtgacatttttagcgcacaccaaaagcctttgaaaatgcctgtttttcaaagttttaatgccattttggggtaagttatctcactttttgttcatcaaaagagaggtagattttaagtaagtgaaacagtagtctgatgagctttttagcgacatgagtgatggcgatatggtaatattttccttgttctaacttctttttgagataggctttgaaagctggagaatatcgagcgactttttgggcagcttgtagtagtgtccatcgtaagtgaggtgagcctctcttgaccattttccctgttaagtccacctgtcctgactggtaaatggacggttcaagtccagcgaaagcttgtagttgagctggtttattaaaggtatgaatgtttctgatttcagctagaataacagaagctaatcgctttccaatcccagtaacagtagtgatgaccgagttgatctcagccatcagcttatcgacatgattttcagctttggcgatgagcctgttatagtgttggatgttctcaatgatttccatcagttcaaactcacgagcagctgaagttgtcccgatagagcttggtgcgaccttgagaatatcctgtattttagggacagttaatcgcttaatttcaattagcttcttcaattatctttttagggctagggtggcgtgatagaagttcatatgcgtagttagaatgcttactgataagtttgtctaacccaggaaagatgatgtcaagacaaggtgtatactggactttccaatctgcttgcttcttctttagccggtggatatgtctggtaagaattttcaattcttcctgtctgttatcctgtcggaattgttcccgattagggtcagagaggagtttcagggcaatgacccgagcgtctttcttatctgtttttgttttacgaagtgagagcgatttggcgaactccttgatgagcagaggattgtcggtgtagacttgatagacttgttcatgaaggaaattcaagagattaaaggtataatgtccagtatcttccagtgcgatgagacaatcttgcttgagttgtttgagggtattaccaagaagttcaaaaccagctctgttgttagagaaagtcatcggtttgagaattacttttccaagttcgttcaagatggttacatcatgtttgtgtttagcgacatcaatgcctacaaaaagcatagcgttacctccgaagattattttcaagtccacttggttatccacgaactttttgccttgttaccttacacgagataaaacgtctatgcgctattaaactcattaccaattgaaacaaaaagtgtggttagagtctttttggaatcgtcaagcgattggaggaaagtaactaatccacagtggctttttccaagtataacacttgggctttggcagtagctaactgcactaaatataatataagggatagggtgcgctcagtgaatataaaagatattatagttcgatatgtagggaaattgatttcagatagaacttacctgaaactgatttattggattaagttccataagaaacttaatttgataaatccaaaaacatttaatgaaaaattgcaatggctgaaaatatatgatcgaaagccagtgtacacaacaatggtggataagtatgaagctaagcaatatgttgaaaacatgatcgggggggggtatattatcccaaccttaaaagtgtataattcagttgacgaaataaacttcgaagaacttccaacacggtttgttttgaaatgtacacataattctggcggaaacgttgtgtgtaaggataaaagctgttgttctgttttggatgcaaaaaaaaaattggagagatacttgaatcgaaactacttctggcaatggcgagaatggccatataagaacgtaagaccaagaattattgcagaagaatatatggaagataaagacggcgagttaagagattataaattcttttcgttcaatggagaagtaaagttttttaaagttgattttaacagatttacgcatcatcaagcgaactactatgatacgaatgggaagttactgaagtttggagaagaaatatgtccgcctgattatgataagaagataatcttgcccgatagtataaatgatatgataaagctggcggaaaaattgtctgcgggctgtccttttttgagagtagatttttatgatgttgacgggaaaatatattttggcgagttgacactttatccagcatcaggtttcggaagatttgaacctgaagaatgggatgaattgatagggctatatttagatttatcaattaatacttctaaagaggaaatgctgagtggcgagtaatataatactaactagcaagtggggattgttattatgaaagcaatatttgtaatgagtacctcttttccatatggagaggctttttcaagcagatcaaggaatttagtaaaattgttatgtgaatgcggatatcacgtacatgtaattgctccgaattcagtagggcaggaagactgtccagaattgtctgaatacaaatactcagtcacacatatacgtgatccgaagaacatatttactctgagtggctttggtacagcaaaaccatatttagtggccgtgaacgactatttgaaaagtaataagatagatttaatagtttcaagcagtatgacgtttgtggcggatcaacttagaaaagtagcagtgaaggaaaacgttccgtatattgtagaacagtgtgagtggtatgattcatctacatttagatttggaaaatggaatccttattatagagaacatattaggagaatagaaaaaaagaatatgaaggtagatggaattattgcaataagtagattgtttgagcagcattattcttttatgaaagtgcctacatttagaattccgactatattagatgttaaaaacatagaatttcggtataaaggtgaaaatgaaaaaaaatatcatatagtctttgctggtagtcttggtaaagggaaagaaaagatggaaccaattttttcagcactgaaaaaagttaatcggtctgaaactaaaatcgtatttgatatatacggagcgaatgaacaaggggtactggataatattgatgggaataaggagttatgggaagatgtgcggccatttgtaaacgtacatggctacattctacagaacgaagtggaaaatgtagtcagagatgcagatttcacaatctttattagacctatacggcggtcatcaaatgctggttttccaactaaatttgcagaaagcatggctgttggcacacctgtcattacaaacaatactggagatatcggattgtatttggaagacagaaaaaatggatttttgcttggtagtggaagtgaaatggaaatagttaacgcttttgaatccattatttcatgtgagcacttcgattacattgaaatgagaaaatgtgcaagaaagactgctgaaaattattttgattatacaaggtatgtggagaatatgaagaaatttttaaaacaattcaactagatttatttaggaaagaaagggaacagtgtgaagaaaaaaaagcatctgaaaaaaattgattctcttgtttatatggtgtccagtctggcatcttttggtttgttatttctgataaatgtaataatgacaaactatagtattagtgatgagatatatggaaaatacaaatatgcggtaaattttgcgcttacaatgccagctatttttagttttggcataacgtggagttgtgcatcattaattgcaagagatgacgttaaaaataaagacggtataattacggcaagtctcatttatactttaattattggagttattgtcactgtaggattgtatattgtttcaggtataacatcagttttaagaatctctgcagttcaagacgctataattgtttttccatttgtaacagtctttcttatacaaaagttagtagatcaaatttatatgggattaggacaagcgaccagattaagtttgtataatgttgcaccaaatattttaatatgtatcggtctagctctacatatctttttctttaagagtataaactttcaatatgcaattatgcttcacttaattagttatgttattgtgattgttcccaaattattggagataaaatatagttttaacgattttaaggataatacaattaccctttttgaggatattagaactagtggattcaaagttcatttttcgtcgatttttactacatctgcaacacaaattattgtacttgtttgtggtaagttatttgggtattctgaatatggttactactctttagcagcgagtctcgcaactatttttcaatttatcggcagttcagttgcagttgtaaattttagacactatgctaatattgacagtatttctcgtaaagatatatattttatgactatattgggaggtgctgcatattgctgtatgtattttttgattgatattgtattttattggttctatccagaaagttatggtccaactatcttgtatttaaaaatattgtgtctgtcaaatttaatttatggtttttcaatgctctttaatagattttttataggaaagggatatggagggaatgttatgaaagtttcttttattactgctgttgcaacggtattaattaacattccgatgattgttttatttggtatgagagggatggctattgctgtgtttgtagtgagcgtcgtgaatctttttgtgtacgtatacgagtataacatatatataagcaaagaaaggtaaggaaaaatgaagattatttgtgataaggcaccctataaatggttgccgtataaggtcttagttggttatattttaagcttacttattctatcaattattggaccagttaggtataattttgatatttttgcattattaatagttattttgtatatacttgcattcattttttttacttgggttggaatggcgaaaagtagcacatacaatccagtttattttgcgaatcagtcgggtagacaaagattagtaaggttgattaaaattggtattattttgattcttcctattaaggtgttgcttgttgtgtcctcaatccagcttatggggttaccctcgtttagcaatatattttcaacattagcatcagtttatacgaggctgcatcacggcgaagagacagagaacatttaccgtcagatagatactttttgtacaatgatattttacttttcgacatttgcaggtatatattggagaaaaaaaatgaaaacattatttttcttcttgattatagtcaatatttcacttgatttattttataatttgtactttattgggacacagaggtctatcataacaattgtagttttaataatgacattatttgcctgcaattcaattgaaagtgattttcacataaataaaagaaaacttaaaaagattatattaacaattagtgtgttgttaattatattttttaacattttatctgcaagaaaaacactttgggcttcttccaatagttatatatatatgaatgagcgttttgatttctacaatcccctacttttctggtgtgtcacagataaactaaaatatgatgtgtgtaatttgttgtcatattttacacaaggtttctatggcttgtctttatcctttcaagttccatttgaatggagctatatgttagggagtgtgagaggattaaatagtattatatctcagttctttccgtttatccctaatatgatagagttgacatatccgttaagagcaggagagtcttttaacttcgacggtcttgttaactggtattcgatatttccttggttagctagtgacctgactttcggtggtgcattgctttatatgggagtggtggcatggttattcatgcgttgttggattcaatctgtaaaatatgacaatccaatagcatttacattgttagttttgctagtaatccagtatgttttcttgattgcaaataatcaactatttgttcaacgtggggaatcattagctacagtttgtctcttatttttctattttatttacggaagtaagagtaacttttcaccggaagagtaagagaattaattttatgtgttcattttcaaattacgatatatgtgcataaataattcacaaagatttttaagtatatattttatctacatttcgcaatctttatttaataataattaacgattttatcggtatcagtcgttcgtaatatattgataaaaatagtgatgatattgttttctattttgaatttagtgagatgttattgaggaataattgtatattacatgatgtattttgtagggataaagcattgtttgaaatttcttattttagttttaaaaatgcttggagtgaaaaatagaaaaacttgtaggttatataaattaattggtttggaaaatccgaaaaatattgtaatgagaaaataactgaatggattatggccgaattaaaagcaagaattaaatgacgtttttacttttaggaagttttctttttatgtgtggtttgtcaatagtgatgttttataatattaaaagtctggaagaaattgatttatcatactagtttgttagctttaatttttgaaaaagataggaattagaaaatgaaattcatgaaaatatttcaaatgcttaagaataggattatgcagtctataaatcctgtaggatgggcaagaaaaattggtgtaaattttcctgaggggggattacatctgtatggaagaacgagttggagtactgaaccgtggattattacattaggtaataatgtccatataactgaaggtgttcgctttattacacatgatggggggacattgctatttagagataaaattccggatcttgatgtaacaaaacctatagttataggaaataatgtatacattggcaataatgttttaattttgccaggtgttacaataggtagtaatgttattattggtgctggcgcggtagtttcaaaaaacattccagataactcagtagctgttggtgtaccagctagagtaattaaaacggcagatgaatatcttaaaaaaatacagaaggaatcattgcattttggacatcttaaaggtcaagaaaaggacaaagcacttatggaatattacggttataagggaaattcaaaaggaatttatttttgatgaattgaagtggaggaaattgaaatgtcactatttatagataaaactttaatgattaccggaggaaccggttcttttggtaatgcggttcttaaccgtttcttgcagaccgatataggagaaatccgaattttctctcgggatgagaagaaacaagacgatatgcgtcaccattttcaagtaactatgccagaagttgcagataagattaagttttacataggggatgtaagagaccttcaatcttgtaagaatgcaatgcgtggtgtagattatattttccatgcagccgcattgaaacaagttccttcgtgtgagttcttccctatggaagctgttaaaacgaatattatcggaacagataatgtattgactgcagcaattgaagagggggtagaagcagtaatttgtctttctacagataaagcagcatatccaatcaatgcgatgggaaaatcgaagtcactggaagaatccgtagctatagcgaagtctcgttattctggtaagactaagatttgctgcacacgttatggcaatgttatgtgtagtcgtgggtctgttataccactttggattgaccagattaaagaaggtaatcctatcactgttactgagcctaatatgacccgctttattatgtcgttagaggaagcggttgatttagtagtgtacgcatttgagcatggtgaaaatggagatttgttgattatgaaggcacctgcatgctctattggattgcaggcagaagctgtttgtgagatgtttggtggtaaaaaagaggatataaaagtcgttggtattcgtcacggtgaaaagatgtatgaaacattgcttactaacgaggagtgtgcaaaggcagttgatctggggaatttctatcgtgtccctgcggataaccgtggcctaaactatgataagtatttcaaagaaggagatatagagagaaatacgttaactgagtttaacagtaacaataccaaattgctgaataaagaagaaatcaaatctaagttgttggagcttaaatatattcaggaaaaacttactaaggaatgaactgaattggttatgctaaactagacagaatttataaagtgttctacgctaaagattttatgtctagaaaacattgccgttacttcatagttgaattcaagcaacaaatcgttgttcttcacaatgcaggaagaaaaagcagtggaattatcaaagaatatgttttaactcttaacctttgacaagtggggtaggtaagcaaaaacgattggcttatgtaaaactgttgataatcttacagatgaacggcgtgggttaattgaactcagaaaatgaaataaagagctagaaatgcaattagacattctaaggcaagtagcggtgattatggcagaaaaaggaaagtaatcgctgctaataagaaaaaatacgtgtttcagctatgtgtcgttggctgaacattccttactctagctattgctacaaaactgtagaaccggtatccgaactaagcaaaacttgaagaaatgattaaaaacattttccgtgagagcaagtctagatatggtgctagaaaactcaagaaaggtctggaaaacgaaggaattatcttgtctcatcggcggattcgtcgcatcatgaagagaagaggctgaatttagtgtcagtttatcagaaggctatcttcaaaccgtattttgaagggaagaatgaagcattagttccaaatctcttagatagacagtttaaccaacaaaagctattagaagcctttttatgttcgtgttggcaatcgttaggcttatgtctacttgattattgacttcttttatcgtgaaattattggttactccttggttggcataagaccactgacttggtcaaagaagtcattcaaaacatcccttatgcgcttaccaatgtcaagattttctatttctaatcaaggtaaggaatttaataaccagctgataaacgagaaatttcaattatcaccccccgtggctagaagagcaagtgcttgataaaaacactttataaattctgtatagaaaagtgttgctttttctaactgtattagaaatggtctagtagaaaagttaatgtaatggaaagttgagtgaattaactaggcttttagacaaggaaactttcaaaagtaggaaaaatgaattttcataatatcaaggatttgtatttctaatcagttgtttattatatatatgtgtgtcgaattgcagtcattgactttagctaagtaataattgcgagaaaaggtttctttttctaagagtattttgaaagtgggcaaaatttgtttttttaacccaatttgtaaaattaagctagacagaaaaagccatctatgttagtctcagataaactaccacatttgtctgaaaggaactaacataaatgacctatacccatcttaccacaaatgaactcgtaatgatagaggcatactaccaagaaggtgcgaaaattcccgaaattatcaaatctttaggtaggtcaaaacaaactatctataatgttatcaactttctcaaagacggacattctgcctatgagtactacgaacgctataaagccaataagaaacgctgtggtcggaggaaaacaagtctttcgcaagcagaaaaagactttattcaaactcacttagaacaaaattggagtcttgatgtcattaaaggagcttattcggataatatttcttgttctatgaggactctctatcgactggctgaccgtggtattttcaagaaagaggatttcccttggcaagggaagagaaagccaaatggtcatagtgaaaaacgaggaaaacaaacgttgggcagagatttacgtgaaagggctgaactctatcctgattttaatacagaatttggacacctagaaggagatacaattgttggtgaaaagcacaaaagtgcggttattaccttggtagaacacctctcaaaagctatcatcacactgaaaacaaatgaacgaaaagcaataggtattgaagttgctatcaatcaatggctgtctcaacttcctaaacatctttttaagtccataacctttgattgtggaaaagaattttctaattggaaatctatttcgaatacgcatgacattggtattttatttgccaattcaggttgccctggtcagagaggtctcaatgaacactcaaacggcttattaaggagacatgggctacccaaacagatggattttaacgggatttctcaaaatttcttatcagctatagctgataagagaaataggattcctagaaagtctttgaattatcaaacgccataccaagtctttctgagttacgtcaaaagtctaacttaatttgacaatttaggaagctaaataatgatatctaccatatttttgataactttatcaatcattttaattgcttgttcaatatgtgcttttttagcaagtaaattaaggaatagtgaattagggttgtgtaagttggtaaaagccctatataaataaagttaaatctttgaatgggatataagttaggttatctaagggagtgtattctgttatcaaggagataatcacgctcaaccagagaagatgctcttttccattgaattgataagttttcctgaatttcaagaaataagttgaactaacagcctctcttaaaataatttttatcagataatttatctttctgactttgcattactaagtacaaaaataatttttatggaaagcactggtgtacagacattaggggtaatacttggttaattgattgttcagcagtctaagcaataaggaaaaaatcaatcatgagtccattctgtgactctattgtttaaaaatagtcagctatattaaaaatgtatactgtgaacttactaagctgctttcattcaattatttaagttattttaatagtgacaatcaattacgttattttagattccaatcctatcacgataacaatatattcagtaattgattgctacaatttcattaattttggaaagttaggaggttacataaaatgaatattgaacataattttaattggaaaaatgatggacgtaccaaagttatgattggttgcggaactcgtccagaaataattcgattggcagctgtaataaaaagatgtagggagtatttcgatacctgcgttgtgtattataaccaaaactgggattccaatctttctactgttttttgggaagattttgaactaaaaaataatacaggagattgtggaccggatattcttgttcctgtggtaggagaaaatctaggagttacttgtggaaatatcttagggcgtagctatgagttactaagtgacttacaacctgatggatatctagttttaggtgatacgaatagttgcctatcagcgatctcagctaagagactacacattccactttttcatatggaggcagggaaccgttgtaaggatgagtgcttacctgaggagacaaatcgacgtatcgtagatgtaatctctgacgttaatctatgctattcagaatttgctagaaagtatttggctgatgcaggacttccaaaagagcgtacctatatgactggttctcctatggcagaagtgcttcgtatgaatttaaataagattgaagaatcagatattctaaatcgtcttggacttgaaccaaataaatatatccttctctctgcacatagagaggagaatattgacacagagaaaaattttataagtctcttcactgcaattaatactttagctgagaaatacgatattccgattctttattcttgtcatccgaggagtaaaagcagattagagaagagtggattcaagttagactcgagagtgcgcgtgaatgaccctttaggatttaatgattataacaaactgcagatgaatgcacttgcaattgtttctgattcaggaacattgccagaggaatcctctttttacctttcaattgggcatccaattgctgcagtgtgtatacgtacatctactgagagaccggaagctctggaagcaggtaattttattcttgcaggtattactacaaaggaactgttgaatgctacagatatggctattgatatgaagaagaaaggcatttttggtaagccttgtccagattatgttgatgagacggtctctatgaaagttgtacgtataattcaaggatatgtaaatgtggttaacaagatggtttggcgaaaagatcagtaagttgtagcaaacgtttattagaaaaaaaggaggtatcaacatgaagatattagtgacaggatctaagggtatggtgggaactgcccttgtgaataacttgaaaaacatccgagataataagaatattacaagaccaaatatccagattgatgaaatttatgagtatgatattgattctacagctgagcagttggataaatattgtcagaatgccgactttgtattcaatcttgcaggtgtgaaccgaccggataatttggaagattttatgcagggaaatttcggtttttcctccgaactattgacaactctgaaaaagtataataataaagctaccataatgctttcttcctcaatccaagctactttaactgggcgattcggggacagtgaatatggtagaagtaaaaaagcaggtgaggacttattcttcgattatgcgagggaaacgggtgcaaaggttgcagtgtatcgtttccctaatttgatggggcacagcaaaccaaagtacaactccgcggtttctaccttctgttgggctgtagctaatgatcaagaatttactgtaaatgatcgttctacagagttggaactcctttacatagatgatctcgtggaaggaatgtttgatttgctggaaggtaaagaaaaacactgtgaatttgatggtgttgaaacagttcagaaagaggaaggaaggtattgttatgttcctactacacataaagtgactcttggggatattgtggatttgctccaacagttcaaagagcatccccagactttaatgattccgaagatgcctgacggttcttttgcgaaaaagctttatagtctgtatttgacctatctacctacagaaaaatttaaatatacactaaaaatgaatattgatgatcgtggcagttttactgagttggttcatacagaagattgtggacaagtatcaattaatatcagtcgaccaggaattactaaaggtcagcactggcataattctaagtgggagctgttcattgtggtagctgggcatgggctgatccaggagcgtaatattaatactggagaaacggtggaatttgaagttagtggagataaaattgaagcaatctatatgattcctggatggacacataatattatcaatttgagtgaaacagagaatcttgtaactgtgatgacatgcaatgaaatttttaatccgcataaaccggatactttttttgaaattgtataaataataattttatagtcaattagtttaattttagtgcaaggcaatgatttatcggcggtactgaagtaatgcaaagcgagttcaaacatttcagtagggtgtttgcagttggaaatagaggctgggctcaagcacagggtcacttctcagagttcgtgtcaacatctcagcgcagtggttgattggctttaacagtctagtggagtgaaacagttcagtgaactgctaaagcccgatcctagaaaggaaaaggcgaggttcaaggttggagataagatttgcgaagcaaatctcagcaattcgtgttttgcacttcaaatctggctttacgactgttgcgaactttgttctctatattcccaacctccaaaggttccccgaacctttggagctatatggggcgggagtgaaacggtttggggaactggttcagctcaacaacttaaaacgagaaattgttgacgaactcttttttgacctagtcgagttccttcccactcccttgctcgtcgaagtaacgaaagataaattaaagggctatataataaaaatatgcggtttacccgtggtgttattctcgtttcaatttattaaaggaaagtttatcatgaaaaaaatcttaatcacaggttcagctggtttcatcggtagcaacctagtattagaactattaaggagtgacgaagcatatcatattatcggtcttgataatatgaacgattactaccaagtatcgctcaagcattatcgtcttgaacagattgagcaacagttgactcatagtaaaagcaagtggactttcatagagggagacttggcagacaaggatttggtcacttcaatttttgaagattaccatccgaatattgttgttaatttagctgctcaggctggagttcgctattccattaccaatccagatgtttatatagaaagcaatattattggttttcagaatatcttggaagcctgtcgtcactacccagttgagcatttagtttatgcttcatcatcttcggtttatggtggaaatgagaaagtaccattttctacggatgataaggtagataatccagtatcgctttatgcagcaactaaaaagtcaaatgaattgtttgctcatgcctacagcaagctctatgatattccaacaacgggactacgtttctttacggtctacggtccagcaggtcgtccagatatggcttacttcggttttactaacaagctgttaaaaggtgaaacgatagaaattttcaactatggaaattgtaaacgtgattttacctatgtagatgacatagtagaaggtgttaaacgtgtcatgtttggtgcaccgcagaagagaggtggaagtgatggtctccctattccgccgtatgcaatctacaatattggcaatagcaatcctgaaaacttattggattttgttcacatattgagtgaggaactagttttggcaggagtattaccagcagattttgatattgaagcacataagaaacttgtgcctatgcaagctggagatgtaccagtaacctatgctgatacttctgatttggagagagattttggttttagcccctctaccacactcagagaaggcttacgccaatttgctaaatggtataaagagtattacaaatagttttattttgctattggggcgatagccttttggacaaatgccataatttgtgtcaggattagtaagaaaagactaataataaagttcactgctaataaggaggttttatgtatagtaagtatgaaattactcacgtagcatgtgatagaaaacaggatgtaaagacagtttataatgagtacaaggctaataagcaacaattcatcaacaaaattgcaaattgtgttaaagatgacgtattaaagacttattttagtcggattattcatgattatgatgagaaaatttacattgattctgtagagagagttttaaagaatcgagaattagtatctcaaaataaagataaaattttaaaaacattgaaattttatgataaaagaaatctgtctgattgtgagtttttaaatgagagtaatgtagaagtatatctaaactcccttcatattaacaatgacaggcttgctttctacttaaaacagttaaatggtgattataatgatgcttaagttgtatatttgattgtactttctttttaacaatcattattttgattttttttgtaacaaatggtatactttgtatatcatttttttgatgaggtgaaattatgagtaacaaagaattttctcaagaatttcttaaaactattattttttctaaaagaaaagagttaggatattctcagcaggaactttctgatttgacaggaataaatagggctatgattagcaagttggagcaaggggagtatcttccttcgattccccagttattggctttgagcaatgtgcttgattttgaaattaacagtttatttgtttctgattttccgaagtcaatcggcactcttccggcaaaaaaaatcgctgtcgcaggaacgggctatgttgggctatctattgctgttttactagcccagcatcatcaaatcacagctgtggatattatccaagaaaaagttgatttaatcaatgcaaagaagtctcctattcaagatgattatatagagaaatatctcgcggaaaaggacttgaatttagtagcaacacttgatgcagaaacagcctacagagaggcagaaattgttgtgatcgctgctccaacgaactatgatagtgctaagaattacttcgatacaagtcatgtggaagaagttattcaaacagtattatcggtcaaccctcaagctttaatggttatcaaatcaacgattcctgttggctttacccaatctatgcgtgagaaatttgctacggacaatattatttttagcccggagtttcttagagagtcaaaagcactttatgataatctttacccttcacgaattattgtgtcttgtgaagaagggactccaacttcggtagtagaaggttcaagattatttgcctcacttctacaagagggagccttgaaggaagatgttgatgtactctatatggggtcgacagaagcagaagcagtcaagctctttgctaatacttacttagccctgcgtgtttcttacttcaatgaattggatacctatgcagagttgaaagggctggataccgaatccattatcaagggtgttggcttagatccacgtattggtgaccactacaataacccttcttttggctatggtggatactgtctaccaaaagatactaagcagttgttggcgaattacaatgatgttccgcagaatatgatgtctgctattgtagagtcaaataggactcgtaaggattttattgctgatcaaattttgaagatagctggttattatgattattcgtcacatgatcaatattctcaatcgggagaaaaagaagtgatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacaccgtaaccgcccaataacaaggtatctatccacccactccctcctccagtatactgttagaaaaacaaaactggaggatttattatgtcacaccccatcattccattgactgttccccaatctcgccgctttgagaagcgaggcagaaacgatattatgatgaaaattcgtctcggaaaagtggagctcacagtctttcacactatcaatcaagaaacactagaaacaatcttagataaggtactgttctatgaccatccaactcagtgatttaggtcaagtttacttggtctgtggaaaaacagatatgcgtcagggaattgattccctggcctatcttatcaaaagtcagttcaacctggatcccttctccggtcaggtctatctcttctgcggaggtcgaaaagaccggttcaaagctctttattgggatggacagggattttggttattgtataaacgttttgaaaatgggaaattgacctggccaaacaatgaagaagaggtcaaggctctaacttccgagcaagtcgactggctcatgaaaggattttctatcattccaaaaataaatgtttcaaaaagtcgtgatttctattgaaatcatggcttttctttgtgtataatgagataaaaagaaggagattggttatgtcatcactagaaaaaattattgaaacacagtcaaaaacgatagagatgatggctaatgaactcactctccttcgagaacaggttgactatctgagacagaaactctacggaaaatcatcagagaaggtcgtatatcaaccaggtcagctgagcttgtttggggaggaaagtctccctgaagaagaagctgacttacccagttgaaacggagaccatcacctataaacgcaagaaagctaagggagttcgtcaggctattttcagccagttcactccagagattgtgcatcacgaattgcagggcgaagactgcacttgtccagactgtcatggtcagctgaaagagattggctcaactgttcaacgacaagagttggtcttcattcctgcacaattaaagcggattgaccatgttcaacacgcatacaagtgtcaggcatgtagtcagaagaatctaagcgataagattatcaaggctcctgttcctaaggcacctttggcacacagcttgggttcagcctctatcatcgctcacaccattcaccagaaattcaatctgaaggtacccaattaccgtcaggaagaggactggcataaacttggcctgcccatcagtcggaaggaaatagccaactggcacatcaagtctagtcagtattatttcgagccgatttataacctgttgcacgagaaattgttggagcagcctattcttcatgcggatgagacttcctacaaggtcttagaaaatgatagccagttgacctactactggactttcttgtctgggaaacatgagaaaaatggaattaccctctatcatcatgacaaacgacggagcggcttagttgtggaggagtttcttggggactatgcgggctacgttcattgtgacatgtggagtgcttatcgtcaattagacaaggctcagctcgttggctgttgggctcatgttagacgaaaattttttgaggcgactcctaagaagacagacaatacttctttaggagcgaagggtttagcctattgcgaccgcctgtttgccttggagagtgactgggctgacctgtctactgaggaacggctacataaacggcagacagagttaactcccttgatggacgagttctttgattggtgccgtgaacaggctgtcttgccagcttccaaattgggtactgcaatagagtatagcctcaaatacgaaaccaccttccgagccgttctctcggacggtgacctagtcctgtccaacaatatggctgagagggctatgaagaccttggtgatgggcagaaaaaattggcttttttctcagagctttgagggagccaagtcgacagctgtcattttgagtcttttagaaacagctaagcgacacggacttgatgcagaaaaatatatgacctatcttctagaacacttacctaatgaggagtcgctcgcaaaaaaggaggttttagaagcctatttgccatgggataaaaatattaagagagcttgtaaatagaaaaaggttccagagtcgacaggactttggagccttttcaatataccttgttattgggcgcttacctaacacctagagaggacgaaattcgttctctcatttttgatgtttaaaacaatatatatcttggttttaaagttcctaaagccgaacgcttgcctcttgatgtctttgatgagtttattggtcgattccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgccagtgatttttcatggatcgataaggtagggaatgcgtatcgaaagtcttcataatatcaattctagtcgtcatcatagcacggctcaggtattggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtgctttggcggttgttgtcaagaatggtcacaatcgatctcgtctcaaaattctgagcaataaaggcgagttttcccttgttccgactaaattcatcccagctcaagacttttggtaatttcgtaaaatcatgctccaattgaaactgagccagtttcctctggacgaccgatacggagatatgtaatctcctagcgatggctatattggtcatgttttctgtatggagttgtgtcactttctcccaaataggtagggaaatctgacagtttttcttgactagagctgtctcagctacagtcactttttggcaagatttgcattgaaaccgccgtttcttaagcaagaggagggtcggaaagccctgacaatccaaaatcggaatctttgacgacttttgaaagtcgtacttgatacactttccttggcaatgaggacaacgagggctgtcgtaatctagctttgccctgatttctagatgggtctgatgtttcaaaatgaagagaattttgatgtttttgtctttgattccaattagttctgtggtatgatcttcgcttttttatttctaggctcaggaatccagagtcacttccctgactctggatttattccatatgagtctttctaatgtgagtgtggttgcttttcattataggttatatgggactttttgtatatattcaaaaaggctccataatctctacagtggatttacccactacagaaattatagagccgaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaccaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcctcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacacttggttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagatgttttatgtattacggtcgcgatactgaaatagaagaattaaaacagcattttaaattttccagtaatgataaaaatagtttatatattattaatggcttaagtggtagtggtaaaaccgagttaatcaaagaggtttgtcaacaagtttacagtcatgataaagaagcgtttattctctacattgatgttacaaatgacgggtttgaaagtaataaattttttgaaaatctactaaaaggagcgtatgtcccaactcaattcagaagaaatctatgcttatcaatacctcaaaaatattcattttcaaattatttaagaaaacaaaaactaacaaatctaactctgaaacatagcatagttttaggttaatcagatctttgatttcattcgatacaacctataaaaaagtaattgattatccttgggaagaagttgttactgaaataaaggagggaatatttgaaagtgatttatatttaagatatttcagtcatgtttcaaaaaaaatccgtctgaatattattattgataattatcaatttttatctgaagatataaaaataaaatttgaagatgactttaatacacttcaaagcggagtctccttaactattataaaccgaacaactgataagttaaaatcaattgataaactagatacattggacaattatactcctactgtattaaatttatcgtatcttactgaggatgagtgtaaattactaataagaaataaaattgctttacttgataatatcaaattgaatcaaatctggcagataacacaaggtaactataaagagattgaattgattattaacagacttattgataatccaaattcagaattatttaatatttctgatatatatgacaaacttccagatattcaaaaaaatatacttctcatatcatcaatttttcctgctggtatgagaaaagatatagtttttaattacattaaatctatagtagatgaaaatattgaagtagctgattctctaaaatcccttattgatgcaggtttcgtatatattaatggagatacaaatgataaaatcaaaatttcacacgaatcaattgtaaatagtattttaaatcacacaaatacttctgatcttcaattagtaaccaacaatctaaaaatatatttagagcaaactatcttatctataggagttggtggcgagttagcttatttaattcactgcttaataaatatatgtaatattaaagagttacgacaaaatgtagaatatatcaaacagttacttgaaatagaatacaggaaaaattcatatttttacattgcatctttgagcaagaagatacatcatttaatagaattattaccataaaaatacttacattatatattgaactcgtaccagtggatttctgatttcaatggaggcttagctattttaaatagccttcaacaagataattattcaaaagatttacaactatactatcctagatttcaaattcaaaaatatgaatttgaggaggcactaaaatcactggaaaagttagaaaatagctctggaacattactctacaagttaaatgcttatggtcatttaggtaaagatcaagatgcaattaaactccttaatgagaccatgaattctgtagaaaaagacgacttctattatattattttacgaaattctgctcattatttcccaaccaaagaagctaccaaaaatctcgaattagcattggactattttcaacgtaatgaatatcaaatacctgttgcaacagtatataataatctaggtgttgttaatatatgggatgggcaatatgatatagctttagagaatataaataaggccgaaaaaatactaaaaaaatatgattcaaatgaaatttttgaaccatattgtaataaatcaattatttttctgatgaataaaaattatcaacaatctctggaatttataaataaatcacttcaagaatgtcctaaagctttgaccttagatattaggatgctcaagttaaacaaattaattattgagttgatttctgaaaaaatctcttttacagaatttcaaaattcactaaagagctttgaggcagaaattccactcatagacgatccttggtataaatttcaaatagtatacaatttacaacaatttgaagatattccttttgtttatgaaaaaacttatattgatgattatcaagacgggctcaccaaatactatctgttgattccatacaaaaaatataatttctgtataggtctttctcctaattggagatattaatttgttcatggtacttgtgaatgagatctaaatatatggaataatcatattgtttatattttaataaattagctactagtttagctaatttttttatatcttcatcagtataggataaatttgtaattccaactgttcctaatctcattcctgaagtcgtcattggtccgtgtgtatcatttggaatttgatttcggttaactaatattttatgctgaaaaagtagattctctgcctccttaccactcaagtttagattcaatagattaactaaaattatatgagtctttggttttttataaacaacatcaaccccctctttacttaattgttttataaacaataaagtattttttataatctgtttagcataatcttgaatatctattgataataatttgattaaacagatacatttcgcaaataatgcagtttgtgtaggcccaccctgtgttctaggaaaaattgaattagttattttttcttcaaatatagaacgatacagtagtactcctccttgaggcccacgtaaacatttatccattgtaaaagtagcgaaatccacatatggaaaaatcgacttatgtagctttgccataatatataaaacactgtggcaaatatccgctaagatgagggtatttgggctaacctcttttataatttcataaatttgttgataattaaattcatttccatacgacgaagcaccaataataatcaatttaggtttatatttatctaataattcctttaattcgatataatcaatatttaagttatggtctaagtgataatattttacagtacctttacctgtataagtatgcgaaatatgtcctccgtcttttggagataacgataaaatataatcgtctctttctaaaacacaattgtagactatttggttagcttgagttcctgaatgtggttgcacattaactctataatcaccaggatttaaatcaaaaagttgaagacacaattcttctgaatatacttcaatattatccaatgaagtacaatgaggaaaaaagcgtttttcaacagctccctctgttggcagagtagcgagagggaaactttgaatctttaatacttcggtgaatggatagctaatacatgcagcaaggtttatcaggctattctgttcttggttatatgaatcaagaattttatttaacttctgatagatttcaccttcaaatttattaattttatacactgatttctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaacgattcgtgtcccaggagataaatcaattagtcatcgctctattatttttggttcccttgcaaaaggtgttacccgtgtccacgatattttacgtggggaagatgtcttgtcaaccatgcaggtctttcgtgatttgggtgtaaaaattgaagacaatggtgatattgttgaagtacacggtgttggttttgatggtcttcaagcgccaaaaaatgatttggatatgggaaattctggaacctcgattcgtttgatttcaggcgttttggcaggtcaagactttgaggcgactatgtttggtgatgattccttgtccaaacgtcccatggaccgagtgactattccactcagtcaaatgggagtagagatttctggacaaactgaacgtgacctacctccgttgaccatcaaagggaataagaatttaaaaccaattcgctaccaactccctgtagcctctgcccaagtaaaatcagctctgatttttgctgccttgcaggctgagggagagtcggtcatcgtagaaaaagaattgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcgtaccaggttcaaaaattgtccttgaaaatgtaggaatcaatgaaactcggactggtattctagatgtcattaaagctatgggcggaaaaatgaccctttctaacatagatgaacttgcaaaatcagcaaccattacagttgaaacgtcggaattgaaggctacggagattgcaggcgaattgatacctcgtttgattgatgagttgccaattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaacactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaagaattgctggacttacctagtaattgtatcgtgtcaactggtggtggggtgattaaatctgaagtaaacagggaattgctgttggcaaatagggaggacaatgtacttcttactgcctcctttgaagtttcctatcagagaattcgtaaggatagacaatcgcaaagacctctctttttacagtgtagtaaggaagagtttgaagccctctatcgtgaacgaatggcactttatcaaggtttagctgatactgtaatcgatacagataaactgaatccagaacaagtagcaaggaaaattttatgcaagtagcctatctaggacctcgtggttcttttacacatcaagtggcccagcaggcctttccgagtgcggatttgcaggcttttgagacgattacagaggttatcaaggcctacgaaacgggagaagttacctattccgttattccagtagagaactcgattgaaggtagtgttcatgaaacgattgactatctctttcatcaggcggagattcatgcggttgccgagattgttcaaccgattgcccaacaactgttagccacgagtgccgataaggctgtagaggttatccattctcatccgcaggcaattgctcaggggaagaaatatattcaggaacattttcctcaggctcgtattgaaataacagctagtacagcctatgctgctcgctttgtggcagaacaccctgaacaaccattcgcggcaattgctccgcaagcggcagcagttgaatatggactggaggtaattgcgcaagacatccaggaaatcagcgagaattttacacgtttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccggcccctgaaaacggctttgggtgagtattttttcatactggatcttgacaatcagtctgaggaattattagcctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccact

SEQ ID NO: 51 - DNA, 35508 bp, Streptococcus suis
tatgacaaaatggaaaattgttgcagattcgggctgtgactatcgtcaattagctaatctagctccgaacactgaatttattagtgtgccacttaccatccaagttggagaacaagcatttgttgatgatgcaagcttggatattgatcacatgatggaggtgatggaagcatctaagtctgcagcggggtctgcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcattatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaatactcaatgaaaatcaacagtagcctaggaaacgaagtcgaagatagaactctgttactatcttatttcaaggtaacaggctgaaaacctccactggagcttttcactcatcaaggcaagttgacaacggataattttgattttcgaagagtataacaattttggaatgtagtttccactatatagaataatccccctcgtctcttaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggagaaagaatccccttgcttagctgaaaggtcacgctccctttggaaattcgatacgggatgttcaaagcgtatttctctaaacaatcttttattttattccactgagcgtgataaatatgatgaagatgctgtgtgttccgtgcaaacataccgttatcaatgtagagcgagagagctttttgcatgataagattggtatcgtagtcgattagactcttatgtttgatgaaggaatcacgtagctgattaggaaggctgattgcaccgattcggagggcaggaaagagtgtcggtgtaaaagattttatgtagatgacacgattatctgtatcaagatagtgtaaaggtaggctatgactagagtcgaaatccgccaaatagtcatcctcaatgatgtagacatcgtattgctttgctaattttacgatggctgtttttgttgctatatcataagttgaaccgagaggattgtgcaagcgaggaattgtgtagaaaaacttgatttttccagtttggaagatactttccaattcttctaggtcaattccatctaaatcccgttcaattgtttgataggggattccttgatgtcgaatgagctctatcattcgtgaataggtagggttctctatcaagatttccgtttttccagcccaggtttccatttgtgtgagaatatatagagcttgttgactaccagctgtgataaccagctggtctttttttgtatagacatgatagtccattaacagactttgaacggaggaaatcaattctgctaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtactttaattccaacatagccttttggacagtgtctttgctacaatgatattgctcactgagttgacggatagaaggtaatttctctccacgtttgaatcggtgttcctctattccagtcaaaatatcttggataataacttgatattttttcatctaggccccctttttatagactatgttactagctagtatataggaaaaattgaagaaagacaatatctggatggggttgaggttcaggaattaagctactatatggtataattaagtgatgaaaataattatacctaatgcaaaagaagtaaatacaaatttagagaatgcctcgttttatcccctgcctgatcgaagtaagccggtactggatgccataagtcaatttgatgtaaaaaagctggctgccttttataaattgaatgaatcaaaggctgagttagaagctgatcgttggcatcgaatcaggacaggtcaagcaaaaaactatccagcctggcagttatatgatggtctcatgtatcgttatatggataggcgaggtatagattcgaaagaagaaaattacctacgtgaccatgttcgtgtagcgacagccttatacggattgattcatccttttgagttcatttcacctcaccgcttagattttcaagggagcttaaagataggcaatcagtctttgaaacagtactggcgaccgtattatgaccaagaagttggtgatgatgaactgattttctcactggcttcgtcagaatttgagcaggtgttttctccacagattcagaaaagattagttaaaattcttttcgtggaagaaaaagcaggtcagctaaaagttcactcgactatatcaaaaaaaggtagaggaagattgctgtcctggttggctaagaacaatattcagaaattatcggacattcaaggttttaaggtggatggctttgaatattgtactgaaaaatcaacagagaatcagctgactttcatacgttcagttaaattatgaaaaaagaacaagataatgtttttcaggttttcaggtaacgtttttcatcactaaatatagctatgtcgctagtaaaagattgttatttgtgatacaataagtaagttataagtaaaaggaaggttgtttatgaagaagagaagcaggtggaggaaatcgcctaagctcaagttggtaaattttgtgctttggggactttatgccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcattcttacttattttttcactagtcatcacttccgtcggaatctatggaatgcaagaagttgtaaaattttcaacacggctaaattcaaattcgacattttcagaatatgaaatgagcatccttgtcccagcaaatagtgatattacagacgttcgtcagcttactagtattcttgctccagccgaatacgaccaagataacatcactgctttattggatgacatatccaaaatggaatctactcaactagcaactagccccgcaacctcttacctgacagcatatcaatctatgataaatggtgagagtcaagcgatggtcttcaacggagtttttaccaatattttagaaaatgaggatccagacttctcttcaaaagtgaggaaaatatatagttttaaggtgactcagactgttgatacagctactaagcaggtgagtggagacagttttaatatctatattagtggtattgatacctacggtccaatttcatctgtttcgcgttccgatgtcaatatcattatgactgttaatcgtgcgacacataagattttattgacaactactccacgagattcatacgttgctatcgcagatggcgggcaaaatcaatacgacaaattaactcatgctggtatttatggtgtcaatgcctctgttcatacattagaaaatctttatggtatcgatatcagtaattatatccgtctcaactttacatccttcttgcagttgattgatttagttggtgggattgatgttgaaaatacccaagaatttacaagcggagggtataatttccctgtggggacagtacacctagacgcagagcaagcgctaatctttgttcgtgagcggtattcgttggctaatggtgataatgaccgtggtaaaaaccaagaaaaagtcattgcagccctcataaaaaaattgagttcaccagagaatttacgcaattatcaagctattttaaatagtttagaagattctattcaaacggatataagtattgaaacaattataggcttagtgaatacgcaattagaatcaggaacacaatttacagtggagtcacaagcgctagttggaaatggtcgaacagacttgccttcttatgccatgccggattcacaactttatatgatggaaattaaccaagatagtctggagcaagcaaaggcctcgattcagtcagtattggatggaaattaaaaaaataggagaaaacatgaataatcaagaaatgaatacaatcgaaattgatattttactcttactgaaaacgatttggagaaaaaaattctttatccttctgatgggactattaggtgcagggttagcttttgcttatagtagttttttggtaacaccgcaatataaatcgacaactcgtatctatgtagtcgggcaacatgctgaagccggtgcgggattaacaaatcaggatttacaagctggttcttatttggtaaaagactataaagaaatcattctatcacaagatgtactgacgcagatagctacagagttgaatttgaatgaaaacctaaaagaaaaggtttcggtttctattcctgttgatactcgtatcgtttctatttccgtgcgtgatgcggatccaaatgaggcagcacgtattgcaaatagccttcgtacctttgcagcgcaaaagattgttgaggtcaccaaagtgagtgaagtgacaacactcgaggaggctgtcccagcagaggagccatcaactcctaatacaaaacgaaatatcatacttggtttattagctggtggtatcttggcaacagctcttgtactggttatggaaattttggatgatcgtgtaaaacgtcctcaggatatcgaagaggtaatgggattgacattacttggtgtagtgccagattcgaagaaattgaaataggagaacaatatggcaacgttagaaattgcacgtacgaagaaagaattagtaaataagacagaagaatattttaacgctatccgtacgaatattcaactcagtggggaagatattaaagtggttggtataacttctgtccaattaaatgaaggaaagagtacaatagcagccagtcttgctattgcctatgctcgttctggctacaagacagttctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttctacaaagtaagaattttgagaacttattagctactcttcgtcggtattttgactatgtggttgtagattgtccacctctagggatggtaattgatgctgcaattattgctcagaagtgtgatgcaatggttttagtagcaggggcaggacatgttaaacgttcagctgtgaaaaaagtaaaggaacagttggagcaaacaggaacacagtttttaggcgttatcttgaacaagtatgatattgcaactgagaaatatggtgattatggaaattatggtaattacggtaaaaaagcttgatttttatgatatgagctttgattaagtaggtgttagtatgattgatgttcattcgcatattatatttggtgtggatgatggtccaaagacaattgaagagagcctgagtttgataggcgaagcttatcgtcaaggtgttcgctatatcgtggcgacatctcatagacgaaaagggatgtttgaaacaccagaaaaagttatcatgactaactttcttcaacttaaagcagcagtagcagaagtttatcctgaaatacgattgtgctatggtgctgaattgtattatagtaaagatatcttaagcaaacttgaaaaaaagaaagtacccacacttaatggctcgcgctatattctcttggagttcagtatgaatactccctggaaagagattcaagaagcagtgaacgaagtgacgctacttgggctaactcccgtacttgcccatatagaacgatatgatgcactagcgtttcatgcagagagagtagaagagctaattgacaagggatgctatactcaggtaaatagtaaccatgtgctgaagcccgctttaattggcgatcgagcaaaagaatttaaaaaacgcactcggtattttttagagcaggatttagtacattgtgttgctagcgatatgcataatttatctagtagacctccgtttatgagggaggcttataagttactaacagaggaatttggtaaagataaagcgaaagcgttgctaaaaaagaatcctcttatgctattaaaaaaccaggcgatttaaactggttactctagattgtggagaaaaaatggatttaggaactgttactgacaaactgttagagcgcaacagtaaacgattgatactcatgtgcatggatacgtgtcttcttatagtttccatgattttgagcaggctgtttttggatgttattattgatattccagatgaacgctttattcttgcagttttatttgttttaatattctacctgattatctcagttagactaaaggttttttcgttaattacgaggtatactggatatcaaagttatgtgaaaataggactgagtttgatatctgcgcattcattgtttttaattatctcaatggtgttgttgcaggcttttagctatcgtttcatcctggtgtccttatttttgtcatttgtaatgctcattaccccaaggattgtttggaaagtcttacatgagacgagaaaaaatgccattcgaaagaaggatagcccactaagaatcttagtagtaggtgctggagatggtgggaatacttttatcaataccgtcgaagatagaaaattggattttgaaattgtcggtattgttgatcgtgatccaaataaacttggaacatttatccgtaccgctaaagttttaggaaaccgtaatgatattccacgattggtagaggaattagctgttgaccaagtgacgattgccatcccttctttaaatggtaaggagcgagagaagattgttgaaatctgtaacactacaggagtgaccgtcaataatatgccgagcattgaagacattatggcggggaacatgtctgtcagtgcctttcaggaaattgacgtagcagaccttcttggtcgaccagaggttgttttggaacaggatgaattgaatcagtttttcaaagggaaaacaatccttgtcacaggagcaggtggctctatcggttcagagttatgtcgtcaaattgctaagtttacgcctaaacgcttgttgttgcttggacatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatacaatccacatgaagcagtgaagaataatatttttggaacgaagaatgtggctgaggcggctaaaactgcaaaggttgccaaatttgttatggtttcaacagataaagctgttaatccgccaaatgtcatgggagcgactaaacgtgttgcagaaatgattgttacaggtttaaacgagcccggtcagactcaatttgcggcagtccgttttgggaatgttctaggtagtcgtggaagtgttgttccgctcttcaaagagcaaattagaaaaggtggtcctgttacggtcaccgactttaggatgactcgttatttcatgacgattcctgaggcaagtcgtttggttatacaagctggacatttggcaaaaggtggagaaatctttgtcttggatatgggcgagccagtacaaatcctggaattggcaagaaaagttatcttgttaagtggacacacagaggaagaaatcgggattgtagaatctggaatcagaccaggcgagaaactctacgaggaattgttatcaacagaagaacgtgtcagcgaacagattcatggaaaaatatttgtgggtcgcgttacaaataagcaatcggacattgtcaattcatttatcaatggattactccaaaaagatagaaatgaattaaaagatgtgttgcttgaatttgcaaaacaagaataaagaaagtaaaagttatttttactttcctagagtttaaatgagatttaaattctaggaaggttgaaatactttcctgaggtaaaatatgttaggtcataggttagtaagagagaaagaaaacagaacgaaaggtggtctctatcataagattcagatcgagctggctttcaactcaaaccacattgaaggcagtcaattaacctatgaccagacaaggtatatctatgagaccaatacgattggttttgaagaaaattcaaccataaaggtggatgatattatcgaaacgaccaatcattttacggcttttgattttctcttagatagctttcaagatgatttgaatgaaacttggataaaggatattcatgctatcttgaagagaggaacctcagattctcggaagttatggtttcaagtcggagattataaattatacccaaatgaagtcggcggtcgtgaaacgactttgccagaaaaagtagaatccgatatgcaagaattgctgaacagctatcaccgcttgcctgagacttcctttgaggatattcttgactttcatgttcgatttgaacgcatccatcccttccaagatggtaacgggcgagtaggtcgattgattatgtttaaagaatgtctcaaacatggacatgtcccctttatcatcggaggtgacatgaagtatttttactatcgtggcttagccgagtggggagagcagaatggtttcttgctggatacttgtctagcagcacaagatagatttaagcaatatttggagtattttaggattgaataaatacagataatcaaaggagatacgataaaatggcatttgatttttcaagagaagtagaaccttttaagaataaggtctggcttgcttcgccaaccatgcatggtgatgaattagagtacatgaaggaagcctatgataccaattggatgacaacggctggttcaaatatcaatgctctagaagaaatgataaaggaatatacaaacagtgaacaagtagtcgcactttcatccggaacatctgctttacatttagctatgaagttggctggaataaagagtggtgactatgttttttgctcagatgtgactttttcagccactgtgaatcctatcacatacgagggtgggatacctgtttttattgattctgagtatgatacctggaatatggacccggaagcgttggagaaagcatttgaaatctatccagctgtgaaagttgttgttttggttcacttatacggagtaccagcaaaaatagatgagatacaagctatttgtgataaacacggtgcaattcttgtcgaagatgcagcagaatccttaggagcaacttatagaggaaaacagacaggaacctttggtcaacattctattatttcttttaatggtaataaaattattacaggttcaagtggtggtgctttattgactaatgagttgaatgcggccaataaagttagaaaatggtcgacacaagctcgtgagcaggctacttggtaccaacatgaagagattggctacaattatcgaatgagcaacgttattgcaggtgtggtacgtgggcaaatgccttatttagacgagcatattgcccagaaaaaagctatttatgaacgttatcaagatggattgaaggatttacctataaaaatgaatccgtttgattcaagcatttccgtaccgaattattggttatcttgtttaactataaatccagaagctatggcaaagcaagtacgttctgataatgatgttctttatacttctgagaagggaaaaactactccttctgaaattttagatgccttgaacacaattaatgcagaaggccgcccaatttggaagccaatgcactcacaaccgatttttagaatgaatcctttcatcacaaaaaatggtaatgggcgtgcacagacaaatgcctatattccaggagattacgctattgtcggtacagatttgtttgagcgtggtttatgtctcccaagtgataataagatgaccgtagaggagcaggacattattatagaaaccataaaggcatgttttgaatagaaaatagagaaatgaaaaagggactatacgaaaaatattttaaacggttgatagattttatcttgtctttaatagcgattattttgctatcccctgtcattattctggtcagtgttctagtatattttaaattaggttcaccagtattatttaagcaagaacgccctggcaaagatgaaaagattttcaaaatgtataagtttcgaacgatgactgatgagagagatgagaagggagagcttttacccgactgtgtgcgcctaacggtattcgggaagtggttacgttcgactagtttagatgaattgcctgaactctttaatattttgaagggggatatgagtatagtaggtccaaggcctttactgtccaaatacttaccgctatactctgaagagcaagctagaagacatgaggttagacctggattgacaggctatactcaagctaatggtcgaaattctttaaattgggaagaaaaatttgtgatggatgttgaatatgtagataatatttcattcaaaggcgatgtaaaaattatttttcaaacggtcatagctgtattcaagagaagcggaatatcatcagctgaatctgtaacaatggaagaatttaaaggaaacaaatgaaaaaacttgctattattggagctagtggtcatggaaaagtagttgctgatattgctgaaaaaaatggttatgatgaaatcatttttttagatgataataatcgttcagccacttttgtagactatccccttgttggagacactgatcaagtaagtgactacagtgattgggaatttattgttgcaattgggaatgctatggtaagaagaaggatccttaaacagcttcagaatttaaaaatagctactctaattcatcctcaagcaatcatcagtagaagagttgtaatcggacaggggactgtggtgatggcaggtgtggtaatcaattcagatgtaacgattgggcaggggtgtataataaacactggctcttctatagatcatgattgtcatttatctgattttgttcatgtctctgtcggggcgcgtgtcgccggatcggtggaaataggtcattctacatggataggtgcaggtgcgacagtgagtaataatgttactttggtaaatagtattatgattggagcaggtggagtagtagtttcagacattttagaagaaggtgtttatataggtgttccggttagaaagatggacttagatgagaatattgattctagcaaataatgatatcggcctttataaatttagaaaagaattaatttatgagcttttaaagcacaatgaagtatatatttccttgccttatggtccattggtagataatttcactgctgcaggatgtaaattcattgaaacccctgttgataggcgaggaatgaaccctatcacggattttaaactgtttatattttataggaagatgataaagagtttgaaaccggaacatgtaattacttatactataaaaccgaacatttatggtgggatagctacgatgttatatagtacagctgcttatcatgttaacgtaactggcctaggcacggtatttcaaaactcaaattttattaagtctgttgttatatggctatacaaaatatcacttataaaatctaagaatgtattttttgaaaatatttctaatagggatgttttcttgaagcatggcattgtgaatattgaaaaaacaaaggttttaaaaggtgcaggtgtcaatcttgatgacttcccactgttaaaatatcctgctgagaacactgtcaaatttttatttgttggcaggattatgaaagaaaagggtattgatgaactatttcaagcaatggaagagttgatttctgaaggttataagtgtacgttagatgttgttggcagttttgaagaaggttatgagcacaaagttcgagaacttggtaccaaagactggttcttctttcatggcttccaggaagatgtactacagttttatcaggcttgtcactgtgaggttctaccgtcctggcatgagggtatggcaaatgttaatttagaggcagcctcctgtggtcgtcctatcatcactagtgatataccgggctgtcgagaggcggtagttgatggtcagagtggttttgttttcaaagtcagagataaggacgatttaaaatcaaaaatgaaaaccgttataaaaatgaccaaggcagaacgtgaaaaaatgggcttagtagggcgcaatcatatgattgcaaactttgaaaagtcgcaagtagtaaatatgactcttgagaaaatcaagttgatgaaataaattttgtgataaggttagagaaagtaactatatgggaaaagaagtacttgttagcattattatgggagcctataataatgaaaacactatatctagagcgattgaatcaatattggcacagacccatcaaaactgggaatttattatatgtgatgattgctcaacagattcaacattgcaaattttagaagaattctctaaaattgatcaaagaataaaagttcttaccaatgcaaaaaactcaaaactagcttatagtttaaatcgatgtttagagtattgtaacggggagtttgttgcaagaatggatgcagatgatatatctaaaaattctagaataagtaagcaacttgactttttacaatcgaatctggatatagatttggttggttcgaatgcatatgttgatagtggtactggagaatatggcgttcgaatggttaaggaggtgccaacaaaagaagatattatatatggaccaacctttatccacccttctgtaatgtttagaaaaaaagccattcttgatattggaggttatacggtttcaaatagaactttcagaggacaagattgggatttatggttcaaattttttgccaatgaattaaaagcatataatattcaagagtatttgctaatttatagtgaacctaaagaagcagctaaaaaacgtacattttttggatcagttgcactttctaaaacggctttttgggggtttaaaaaactaaatgttccactttggaaatatccaatagcgttaaaacctgtagtatctttttttataaaaaaattctttttttagttgggtaagagaaatgagagttttgataacggtaaaaacgtattttccatataaagatggagttcaaacagttactcagtatctcgctgaagggctggtaagacgtggaatagaggtatgtgtcataactagtaagcatcccgaatgtgtggatgaagatgttcataatggtgtcaggataaaaagatttgacttaaatattgttcatagtttctactttggagaaaagaaaaggtatattaaatatgtaaaacgtatggtaaaagactttgatgtactggtcaatgtttgtacacagaatccgtttactgacatactactccctattttgaatcaattagatataaaaaaaatactttatttacacggaatgtttgagttcagacaaccactctttagttttaagtacacttttgtacaaaacttgcaaagactgtggaattttgcaagatggtggtatttatattttgtaatgggcaaatattttaaacaatacgaacaggttatacagttacataaacaagattatgcagttgattttttcaaaaaacattacaataccgactcctatgtgattgaaaatgcagcggaagatatgttttttaatttatcaagagacggaaaaaaaaacaaatttgaaagatatattatttcggtctctaattattttgaaaataaaaatcaggagatgattttagaggctttctacaagagtaatataaattcaagggttggtctagtgtttatcggtagcgaacaaacagagtactatacaaaattgattaaattaaacgaacatttgtcacaaggtaataataaaaatgttcagtttctatatggaatatctagaaaagaaattgctgattacttgaaaaatgcagaattttttgttatggcaagcaagtcagaaaaatttccagtttcgattgtagaagcgatggcctctagtattgcttttatttccactgatgtaggatgtgttcaatatttaccaggtggaatcattgttaacaatgtagaagaaatggttcatgcgatgaataaattagattctgataaaagcttttgtgagaaacttgcaaaaaaaggtttcaaatatgcagttgaaaatttgaaagtcgatgtctgtattacaaagtttatagaaattttgaggttaagatgaaaacaattaggtttatttgtccatattttggaaacttaccaaaagatatacttcctttttggatccagtcatgcaaatataatccaagtatagaatggtatatttttacagatgatgagagtattaatttatttgaattgcctccaaatattacagttataaaaatgacattggatgattatcttgatttatcaaaaaaattatttgattttcctataaagattgaaaacagttacaaactctgtgattataagccattatttggtgctgtcttcgatgaatggttggatggtatagatttttggggccattgtgatattagtgatacactgtatggagatttgagaaaatttttaactgatgaagttttatcaaatgcagataaaataatgtttcttggtcatatgactttatataggaatactgtaactgttaataatcgctacaaaatcaaaacgacctcaaatataacattagaggaaattttttcttcatcagaaaattttgctttcgatgaacttaaaagctatagtataaataaaatttatatagaacaaggttttccaattaaaagactagatgatgcatatgtggacgtcagtccattgtattttagatttagaagtagtaaatatgatgaaaaattcaatcatttaggctacgataatactaaaaggatatttttgtgggaatctggaaaattgttcgaattgtatttaattggtaagtcagtttctagaagagaaattggatatatacattttcaaaaaagaaaattaaagaatgtagatgcagaattcgataagaattattacattactccgaaaggttttatgaattctgataatgtattgaatgtcagaaagctaataaaagattcaaatcgtcgatatattccttactatccttattttaaacaaaaaattcggtcagctaagtataggctaagactttttattcagaactggcgaagcaagaaagggtaaaatatggtgtggtacttctttttgaattctattttttttggaattctattaattatacaaattacgaactttaacaacttaaatagtgattatttaagtttaatgtatatcattttaaatattatttgttctatactatcacgaagattagttttttcgattcctgttctaattgtcagagtgacaggctttattcgatattttatccttgctcaactgatggcgaatattaattaccatgattataatagtacttcattttcattagctttagtagaattaattgctcagtatgcaactttcctatatttatcttttttttcaaacaaaaaagaacgcaatcatgttgaaatacaacatatttttccaaagtttgagatgaatttcattattaaactgctaatgacttttgtgtcaatatattttatatattctccccaattattactaaattttttttcagttagttcaaatagacatgaatatgttcatattaatgggatagttgcgttactatattatgtgggaatagtttgtattttttttaaattgttattttttattcatcgacttaatatttcaaatttttctaaattaaatttgatttttttattggtgataatttacataaatggaatggcgcttaatggtaatgaaatttccagatggtttatctttattacttttctagtaatgttgcatattttacataggctgtactttgataaccgtgtatttgtaatagtctctatagtttcaatatttattgtcagtattattataggaacaatgtataaatttaggataagtgcggggcagtcttactcatggaatgaaacattggcaacaattttttcccctgtaatattaaatgcatacttttcaggaccctacaatatgaatattattgaagatgtaattgaaagaatagtgactctcgatatttttgtacctaaaattttgatatcagacttatttaataatgctccgtttttaaataagtttttgagcgataggctgtacacaacagtttcgttatttaatatttcattttatagttctaccgttgctacagatcagattatccctctcgcaggacaactttatgtatattttggttggtttttttggattgtaactattatcttaacaagtttatcaataaaattggaaaaagttgcgtataagcaaaaaaacattttattaatttatgctacgatgtttctgtccgtttcgctgtcattaggaaatgcaataaatttgataataatgttacagaatttgtggatatttgtccttccaattatcgctgtatattttttggacaatcgaataacatttgataggtaacaattttcatgaagataaagacaaaaagattattgaaggatactgttatttttactattggaaatatcggttcaaaatttatccaatttttcttggttccattgtatacttattcattaactaagtctgaatttggtgttactgaatttatttttactgtagcaaatttagtaacacctttgttctctttttcaatttctgatggcttaataaggtttggtcttgatagaagttatgaaaaaaatgttatattgactaattcagtcgtaattattttgattggcacattgttatctatcttgtgctacccacttttttctactatttctattttaaataaatatataccattatttttgataatactgaatattaggatttttagagatgtattttctataaatctaaagctacaggatcagaataaattatttgctgtggacagtatactttttacagcatcaacatttatttatagtattctcttcttaaaaatttttaatctcggaatttttggatttttttattctcagattcttgcgaatatatgttctattatttttctagtaatcgtaggcaatgtaaaagcatcaattcgaataaactatatagataaaaatattttttggactctaatatgtttttcttttcctatgatggttaatgctatttcatggtgggtaacaaatgctgttgatagagttatactaactagatttgtctcaagttcgtcagttggtttatatgctgttgcgacaaaaattccttcttttgttacaacttttacaggaatttttaatcaagcgtggatattgtcagctgtaggtggccatggggacaaggatgaattagaatttgtttcccaaacatttagaaattattgtttagccatgtatgcttttgcattgttattaattaatttttctgaatctattgtctccatatatgttaactcggagtattttgaggtttggagatacgttccatttttactaactggaacggtattctctggcgtggcaggctttttaggaggcgtgcttataacacataagaaaaatatttttttaatgtggtcaacagttttcggtgcaattttatcagtaattctcaatatactttttgttccaagattaaatataatgggttctgtttatacaaattgtattacgtggtttattgtcgcattcttaaggttgatatttgtaaaaaaatgtaagcatctaaacactagtataataaaaatattttttttatcacttcaacttgtattacagagttttatagtaatacattatcctggatattcttatatgtccatgctgttatttgttgttttggctatactagcgtattcgagtgattttgtagtttttattgcgggtatatatagaaagaggtaaaaatgaatagtattgttgcagtatataggagtatgctcagatatccaatagagttttctaaaaggaaaagattaaagaatgaatcttttacaatttttagttcaaactgtattggtggtattatctataatacgttaggtaaagaattcttgacaccgaccataaacatgtttttttctccagaggatttcattaaattccttaaaaatccaaaagaatatttgagcaaggaattaattaacttggagagtattgattttgcttatccgttggcacaatgcggtgacatcgtgttacatggtgtgtattattcaaattttgatgaattgaaaaattcttgggataggcggaaagagagaattaattgggaaaatatatttattataatggtagaacgtgacggctgtacatctcaggatattttagaattcgattcgcttccgtatgaaaacaaagtaatttttgttagtaagcctatgccggagatcaattccgcatgttatttggaaggtacagaagagtatgttgacaatgttagacaagtaagttcattaactaggtataaatctaggctgacttctttcagatatatagatgacttcgactatgtttcctttctcaatgaagaggtgtaatatgaaattagatacagtatttgtaactggttcagctggtttcatcggtagcaacctagtattagaactattacggagtgacgaagcatatcatattatcggtcttgataatatgaacgattactacgatgtgtcgctaaagcaatatcgtcttgaacagattgagcaacagttgattcatagtaaaagcaagtggactttcatagagggagacttggcagacaaggatctggtcacttcaatttttgaagattaccatcctgatattgttgtcaatctagctgctcaggctggtgttcgctattcgattaccaatccagacgtttatatagaaagcaatattattggtttccaaaatatcttagaagcctgccgtcactacccagtagaacacttggtatatgcgtcttcatcttcagtttatggtggaaatgagaaggttccatttactacagatgataaggtagataatccagtatcgctttatgcagcaactaaaaagtcaaatgaattgtttgcacatgcctacagtaagctctatgatattccaacaacggggctacgtttctttacggtctacggtccagcaggtcgtccagatatggcttactttggttttactaacaagctgttaaaaggtgaaacgatagaaattttcaactatggaaattgtaaacgtgattttacctatgttgatgatattgtggaaggtgtcaagcgtgtcatgtttggcgcaccgcagaagagaagtggaagtgatggtctccctattcctccgtatgcaatttataatattggcaatagcaatcctgaaaacttattggactttgttcacatattgagtgaggaactagttttggcaggagtattgccagaagattttgatattgaagcacataagaaacttgtgcctatgcaagctggagatgtaccagtaacctacgctgatatctctgatttagagcgtgattttgcttttagcccctctaccactctcagagaaggcttgcgccaatttgctcaatggtataaagagtattacaaatagttttattttgctattggggcgatagccttttggacaaatgccataatttgtgtcaggattagtaagaaaggactagtaaataacattcactaacttcgtgagatttgcatctggtttttcctcttacattaaaaggagttaatcatgataaaagacattcattcgatttcattgttcaaacaaaatcttaatttggatatagtgccagaactgtaggaagatggataattttcatagttgattttactttctttttaataatcattattttgattttttaagtaacaaatggtatactttgtataccatttttatattgaggttaaattatgagtaacaaagaattttctcaagaatttcttaaaactattattttttctaaaagaaaagagttaggatattctcagcaggaactttctgatttgacaggaataaatagggctatgattagcaagttggagcaaggggagtatcttccgtcaattccgcaattactttctctgagcaatgtgcttgattttgaaataaacagtttatttgtttctgattttccgaagtcaatcggcactcttccggcaaaaaaaatcgctgtcgcaggaacaggctatgttggtctatctatcgctgttttactagctcagcatcatcaactcacagctgtggatattatccaagaaaaagttgatttaatcaatgcaaagaagtctcctattcaagatgattatatagagaaatatctcgcggaaaaggacttgaatttagtagcaacacttgatgcagaaacagcctacagagaggcagaaattgttgtgatcgctgctccaacgaactatgatagtgctaagaattacttcgatacaagtcatgtggaagaagttattcaaacagtattatcggtcaaccctcaagctttaatggttatcaaatcaacgattcctgttggctttacccaatctatgcgtgagaaatttgctacggacaatattatttttagcccggagtttcttagagagtcaaaagcactttatgataatctttacccttcacgaattattgtgtcttgtgaagaagggactccaacttcggtagtagaaggttcaagattatttgcctcacttctacaagagggagccttgaaggaagatgttgatgtactctatatggggtcgacagaagcagaagcagtcaagctctttgctaatacttacttagccctgcgtgtttcttacttcaatgaattggatacctatgcagagttgaaagggctggataccgaatccattatcaagggtgttggcttagatccacgtattggtgaccactacaataacccttcttttggctatggtggatactgtctaccaaaagatactaagcagttgttggcgaattacaatgatgttccgcagaatatgatgtctgctattgtagagtcaaataggactcgtaaggattttattgctgatcaaattttgaagatagctggttattatgattattcgtcacatgatcaatattctcaatcgggagaaaaagaagtgatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacaccgtaaccgcccaataacaaggtatctatccacccactccctcctccagtatactgttagaaaaacaaaactggaggatttattatgtcacaccccatcattccattgactgttccccaatctcgccgctttgagaagcgaggcagaaacgatattatgatgaaaattcgtctcggaaaagtggagctcacagtctttcacactatcaatcaagaaacactagaaacaatcttagataaggtactgttctatgaccatccaactcagtgatttaggtcaagtttacttggtctgtggaaaaacagatatgcgtcagggaattgattccctggcctatcttatcaaaagtcagttcaacctggatcccttctccggtcaggtctatctcttctgcggaggtcgaaaagaccggttcaaagctctttattgggatggacagggattttggttattgtataaacgttttgaaaatgggaaattgacctggccaaacaatgaagaagaggtcaaggctctaacttccgagcaagtcgactggctcatgaaaggattttctatcattccaaaaataaatgtttcaaaaagtcgtgatttctattgaaatcatggcttttctttgtgtataatgagataaaaagaaggagattggttatgtcatcactagaaaaaattattgaaacacagtcaaaaacgatagagatgatggctaatgaactcactctccttcgagaacaggttgactatctgagacagaaactctacggaaaatcatcagagaaggtcgtatatcaaccaggtcagctgagcttgtttggggaggaaagtctccctgaagaagaagctgacttacccagttgaaacggagaccatcacctataaacgcaagaaagctaagggagttcgtcaggctattttcagccagttcactccagagattgtgcatcacgaattgcagggcgaagactgcacttgtccagactgtcatggtcagctgaaagagattggctcaactgttcaacgacaagagttggtcttcattcctgcacaattaaagcggattgaccatgttcaacacgcatacaagtgtcaggcatgtagtcagaagaatctaagcgataagattatcaaggctcctgttcctaaggcacctttggcacacagcttgggttcagcctctatcatcgctcacaccattcaccagaaattcaatctgaaggtacccaattaccgtcaggaagaggactggcataaacttggcctgcccatcagtcggaaggaaatagccaactggcacatcaagtctagtcagtattatttcgagccgatttataacctgttgcacgagaaattgttggagcagcctattcttcatgcggatgagacttcctacaaggtcttagaaaatgatagccagttgacctactactggactttcttgtctgggaaacatgagaaaaatggaattaccctctatcatcatgacaaacgacggagcggcttagttgtggaggagtttcttggggactatgcgggctacgttcattgtgacatgtggagtgcttatcgtcaattagacaaggctcagctcgttggctgttgggctcatgttagacgaaaattttttgaggcgactcctaagaagacagacaatacttctttaggagcgaagggtttagcctattgcgaccgcctgtttgccttggagagtgactgggctgacctgtctactgaggaacggctacataaacggcagacagagttaactcccttgatggacgagttctttgattggtgccgtgaacaggctgtcttgccagcttccaaattgggtactgcaatagagtatagcctcaaatacgaaaccaccttccgagccgttctctcggacggtgacctagtcctgtccaacaatatggctgagagggctatgaagaccttggtgatgggcagaaaaaattggcttttttctcagagctttgagggagccaagtcgacagctgtcattttgagtcttttagaaacagctaagcgacacggacttgatgcagaaaaatatatgacctatcttctagaacacttacctaatgaggagtcgctcgcaaaaaaggaggttttagaagcctatttgccatgggataaaaatattaagagagcttgtaaatagaaaaaggttccagagtcgacaggactttggagccttttcaatataccttgttattgggcgcttacctaacacctagagaggacgaaattcgttctctcatttttgatgtttaaaacaatatatatcttggttttaaagttcctaaagccgaacgcttgcctcttgatgtctttgatgagtttattggtcgattccagcttagcgttggaatatggaagctccatggcgttcgtgatgtacgttttatactttagaaaagttttaaaaacagttttaaaggcaggattgacaagatccagattgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgccagtgatttttcatggatcgataaggtagggaacgcgtatcgaaagtcttcataatatcaattctagtcgtcatcatagcacggctcaggtattggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtgctttggcggttgttgtcaagaatggtcacaatcgatctcgtctcaaaattctgagcaataaaggcgagttttcccttgttccgactaaattcatcccagctcaagacttttggtaatttcgtaaaatcatgctccaattgaaactgagccagtttcctctggacgaccgatacggagatatgtaatctcctagcgatggctatattggtcatgttttctgtatggagttgtgtcactttctcccaaataggtagggaaatctgacagtttttcttgactagagctgtctcagctacagtcactttttggcaagatttgcattgaaaccgccgtttcttaagcaagaggagggtcggaaagccctgacaatccaaaatcggaatctttgacgacttttgaaagtcgtacttgatacactttccttggcaatgaggacaacgagggctgtcgtaatctagctttgccctgatttctagatgggtctgatgtttcaaaatgaagagaattttgatgtttttgtctttgattccaattagttctgtggtatgatcttcgcttttttatttctaggctcaggaatccagagtcacttccctgactctggatttattccatatgagtctttctaatgtgagtgtggttgcttttcattataggttatatgggactttttgtatatattcaaaaaggctccataatctctacagtggatttacccactacagaaattatagagccgaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaccaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcctcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacacttggttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagaaatcagtgtataaaattaataaatttgaaggtgaaatctatcagaagttaaataaaattcttgattcatataaccaagaacagaatagcctgataaaccttgctgcatgtattagctatccattcaccgaagtattaaagattcaaagtttccctctcgctactctgccaacagagggagctgttgaaaaacgcttttttcctcattgtacttcattggataatattgaagtatattcagaagaattgtgtcttcaactttttgatttaaatcctggtgattatagagttaatgtgcaaccacattcaggaactcaagctaaccaaatagtctacaattgtgttttagaaagagacgattatattttatcgttatctccaaaagacggaggacatatttcgcatacttatacaggtaaaggtactgtaaaatattatcacttagaccataacttaaatattgattatatcgaattaaaggaattattagataaatataaacctaaattgattattattggtgcttcgtcgtatggaaatgaatttaattatcaacaaatttatgaaattataaaagaggttagcccaaataccctcatcttagcggatatttgccacagtgttttatatattatggcaaagctacataagtcgatttttccatatgtggatttcgctacttttacaatggataaatgtttacgtgggcctcaaggaggagtactactgtatcgttctatatttgaagaaaaaataactaattcaatttttcctagaacacagggtgggcctacacaaactgcattatttgcgaaatgtatctgtttaatcaaattattatcaatagatattcaagattatgctaaacagattataaaaaatactttattgtttataaaacaattaagtaaagagggggttgatgttgtttataaaaaaccaaagactcatataattttagttaatctattgaatctaaacttgagtggtaaggaggcagagaatctactttttcagcataaaatattagttaaccgaaatcaaattccaaatgatacacacggaccaatgacgacttcaggaatgagattaggaacagttggaattacaaatttatcctatactgatgaagatataaaaaaattagctaaactagtagctaatttattaaaatataaacaatatgattattccatatatttagatctcattcacaagtaccatgaacaaattaatatctccaattaggagaaagacctatacagaaattatattttttgtatggaatcaacagatagtatttggtgagcccgtcttgataatcatcaatataagttttttcataaacaaaaggaatatcttcaaattgttgtaaattgtatactatttgaaatttataccaaggatcgtctatgagtggaatttctgcctcaaagctctttagtgaattttgaaattctgtaaaagagattttttcagaaatcaactcaataattaatttgtttaacttgagcatcctaatatctaaggtcaaagctttaggacattcttgaagtgatttatttataaattccagagattgttgataatttttattcatcagaaaaataattgatttattacaatatggttcaaaaatttcatttgaatcatatttttttagtattttttcggccttatttatattctctaaagctatatcatattgcccatcccatatattaacaacacctagattattatatactgttgcaacaggtatttgatattcattacgttgaaaatagtccaatgctaattcgagatttttggtagcttctttggttgggaaataatgagcagaatttcgtaaaataatataatagaagtcgtctttttctacagaattcatggtctcattaaggagtttaattgcatcttgatctttacctaaatgaccataagcatttaacttgtagagtaatgttccagagctattttctaacttttccagtgattttagtgcctcctcaaattcatatttttgaatttgaaatctaggatagtatagttgtaaatcttttgaataattatcttgttgaaggctatttaaaatagctaagcctccattgaaatcagaaatccactggtacgagttcaatatataatgtaagtatttttatggtaataattctattaaatgatgtatcttcttgctcaaagatgcaatgtaaaaatatgaatttttcctgtattctatttcaagtaactgtttgatatattctacattttgtcgtaactctttaatattacatatatttattaagcagtgaattaaataagctaactcgccaccaactcctatagataagatagtttgctctaaatatatttttagattgttggttactaattgaagatcagaagtatttgtgtgatttaaaatactatttacaattgattcgtgtgaaattttgattttatcatttgtatctccattaatatatacgaaacctgcatcaataagggattttagagaatcagctacttcaatattttcatctactatagatttaatgtaattaaaaactatatcttttctcataccagcaggaaaaattgatgatatgagaagtatatttttttgaatatctggaagtttgtcatatatatcagaaatattaaataattctgaatttggattatcaataagtctgttaataatcaattcaatctctttatagttaccttgtgttatctgccagatttgattcaatttgatattatcaagtaaagcaattttatttcttattagtaatttacactcatcctcagtaagatacgataaatttaatacagtaggagtataattgtccaatgtatctagtttatcaattgattttaacttatcagttgttcggtttataatagttaaggagactccgctttgaagtgtattaaagtcatcttcaaattttatttttatatcttcagataaaaattgataattatcaataataatattcagacggattttttttgaaacatgactgaaatatcttaaatataaatcactttcaaatattccctcctttatttcagtaacaacttcttcccaaggataatcaattacttttttataggttgtatcgaatgaaatcaaagatctgattaacctaaaactatgctatgtttcagagttagatttgttagtttttgttttcttaaataatttgaaaatgaatatttttgaggtattgataagcatagatttcttctgaattgagttgggacatacgctccttttagtagattttcaaaaaatttattactttcaaacccgtcatttgtaacatcaatgtagagaataaacgcttctttatcatgactgtaaacttgttgacaaacctctttgattaactcggttttaccactaccacttaagccattaataatatataaactatttttatcattactggaaaatttaaaatgctgttttaattcttctatttcagtatcgcgaccgtaatacataaaacatctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaacgattcgtgtcccaggagataaatcaattagtcatcgctctattatttttggttcccttgcaaaaggtgttacccgtgtccacgatattttacgtggggaagatgtcttgtcaaccatgcaggtctttcgtgatttgggtgtaaaaattgaagacaatggtgatattgttgaagtacacggtgttggttttgatggtcttcaagcgccaaaaaatgatttggatatgggaaattctggaacctcgattcgtttgatttcaggcgttttggcaggtcaagactttgaggcgactatgtttggtgatgattccttgtccaaacgtcccatggaccgagtgactattccactcagtcaaatgggagtagagatttctggacaaactgaacgtgacctacctccgttgaccatcaaagggaataagaatttaaaaccaattcgctaccaactccctgtagcctctgcccaagtaaaatcagctctgatttttgctgccttgcaggctgagggagagtcggtcatcgtagaaaaagaattgactcgaaaccatacagaagatatgattgtccagtttggtggacagttagaagtcaatggcaaggaaatccgcatccaaggtggtcaggagtttattgcccaagagattacagttccaggagatatttcaagtgctgctttttggttggttgctggcttaatcgtaccaggttcaaaaattgtccttgaaaatgtaggaatcaatgaaactcggactggtattctagatgtcattaaagctatgggcggaaaaatgaccctttctaacatagatgaacttgcaaaatcagcaaccattacagttgaaacgtcggaattgaaggctacggagattgcaggcgaattgatacctcgtttgattgatgagttgccaattattaccttactagcgactcaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaacactagctatcctgccttctttgaacacttaaatagtttgatggattaggagaacgtatgccaatcgttttacttggatttatgggagttggaaaaacaacaacagcacatttgttaaatctccccgtttacgatatggaccatatcattgaagaacggattggtatgcctattgctgactatttcagtcttgaaggagaggcttcgtttagacaactggagacagaggtactgaaagaattgctggacttacctagtaattgtatcgtgtcaactggtggtggggtgattaaatctgaagtaaacagggaattgctgttggcaaatagggaggacaatgtacttcttactgcctcctttgaagtttcctatcagagaattcgtaaggatagacaatcgcaaagacctctctttttacagtgtagtaaggaagagtttgaagccctctatcgtgaacgaatggcactttatcaaggtttagctgatactgtaatcgatacagataaactgaatccagaacaagtagcaaggaaaattttatgcaagtagcctatctaggacctcgtggttcttttacacatcaagtggcccagcaggcctttccgagtgcggatttgcaggcttttgagacgattacagaggttatcaaggcctacgaaacgggagaagttacctattccgttattccagtagagaactcgattgaaggtagtgttcatgaaacgattgactatctctttcatcaggcggagattcatgcggttgccgagattgttcaaccgattgcccaacaactgttagccacgagtgccgataaggctgtagaggttatccattctcatccgcaggcaattgctcaggggaagaaatatattcaggaacattttcctcaggctcgtattgaaataacagctagtacagcctatgctgctcgctttgtggcagaacaccctgaacaaccattcgcggcaattgctccgcaagcggcagcagttgaatatggactggaggtaattgcgcaagacatccaggaaatcagcgagaattttacacgtttttggattttgggggataaggctccgtctattgccctggaacaagtagctaaaaaagtcagtcttgcactgacattgccagataacctgccaggagccttgtataaggccatgtctgttttctcatggagaggaatcagcttaacaaaaatagaaagccggcccctgaaaacggctttgggtgagtattttttcatactggatcttgacaatcagtctgaggaattattagcctattctcaaaaagaatt

SEQ ID NO: 52 - DNA, 30791 bp, Streptococcus suis
attacaggtgggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcattatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggctatgatggaggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaatactcaatgaaaatcaacagtagcctaggaaacgaagtcgaagatagaactctgttactatcttatttcaaggtaacaggctgaaaacctccactggagcttttcactcatcaaggcaagttgacaacggataattttgattttcgaagagtataacaattttggaatgtagtttccactatatagaataatccccctcgtctcttaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggagaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagcgagagagctttttgcatgataagattggtatcgtagtcgattagacttttatgtttgatgaaggtatcatgtagctgattaggaaggctgattgcaccgattcggagggcaggaaagagtgtcggtgtaaaagattttatgtagatgacacgattatctgtatcaagatagtgtaaaggtaggctatgactagagtcgaaatccgccaaatagtcatcctcaatgatgtagacatcgtattgctttgctaattttacgatggctgtttttgttgctatatcataagttgaaccgagaggattgtgcaagcgaggaattgtgtagaaaaacttaatttttccagtttggaagatactttccaattcttctaggtcaattccatctaaatcccgttcaattgtttgataggggattccttgatgtcgaatgagctcgatcattcgtgagtaggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtactttaattccaacatagccttttggacagtgtctttgctacaatgatattgctcactgagttgacggatagaaggtaatttctctccacgtttgaatcggtgttcctctattccagtcaaaatatcttggataataacttgatattttttcatctaggccccctttttatagactatgttactagctagtatataggaaaaattgaagaaagacaatatctggatggggttgaggttcaggaattaagctactatatggtataattaagtgatgaaaataattatacctaatgcaaaagaagtaaatacaaatttagagaatgcctcgttttatcccctgcctgatcgaagtaagccggtactggatgccataagtcaatttgatgtaaaaaagctggctgccttttataaattgaatgaatcaaaggctgagttagaagctgatcgttggcatcgaatcaggacaggtcaagcaaaaacctatccagcctggcagttatatgatggtctcatgtatcgttatatggataggcgaggtatagattcgaaagaagaaaattacctacgtgaccatgttcgtgtagcgacagccttatacggattgattcatccttttgagttcatttcacctcaccgcttagattttcaagggagcttaaagataggcaatcagtctttgaaacagtactggcgaccgtattatgaccaagaagttggtgatgatgaactgattttctcactggcttcgtcagaatttgagcaggtgttttctccacagattcagaaaagattagttaaaattcttttcgtggaagaaaaagcaggtcagctaaaagttcactcgactatatcaaaaaaaggtagaggaagattgctgtcctggttggctaagaacaatattcagaaattatcggacattcaaggttttaaggtggatggctttgaatattgtactgaaaaatcaacagagaatcagctgactttcatacgttcagttaaattatgaaaaaagaacaagataatgtttttcaggttttcaggtaacgtttttcatcactaaatatagctatgtcgctagtaaaagattgttatttgtgatacaataagtaagttataagtaaaaggaaggttgtttatgaagaagagaagcaggtggaggaaatcgcctaagctcaagttggtaaattttgtgctttggggactttatgccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcattcttacttattttttcactagtcatcacttccgtcggaatctatggaatgcaagaagttgtaaaattttcaacacggctaaattcaaattcgacattttcagaatatgaaatgagcatccttgtcccagcaaatagtgatattacagacgttcgtcagcttactagtattcttgctccagccgaatacgaccaagataacatcactgctttattggatgacatatccaaaatggaatctactcaactagcaactagccccgcaacctcttacctgacagcatatcaatctatgataaatggtgagagtcaagcgatggtcttcaacggagtttttaccaatattttagaaaatgaggatccagacttctcttcaaaagtgaggaaaatatatagttttaaggtgactcagactgttgatacagctactaagcaggtgagtggagacagttttaatatctatattagtggtattgatacctacggtccaatttcatctgtttcgcgttccgatgtcaatatcattatgactgttaatcgtgcgacacataagattttattgacaactactccacgagattcatacgttgctatcgcagatggcgggcaaaatcaatacgacaaattaactcatgctggtatttatggtgtcaatgcctctgttcatacattagaaaatctttatggtatcgatatcagtaattatatccgtctcaactttacatccttcttgcagttgattgatttagttggtgggattgatgttgaaaatacccaagaatttacaagcggagggtataatttccctgtggggacagtacacctagacgcagagcaagcgctaatctttgttcgtgagcggtattcgttggctaatggtgataatgaccgtggtaaaaaccaagaaaaagtcattgcagccctcataaaaaaattgagttcaccagagaatttacgcaattatcaagctattttaaatagtttagaagattctattcaaacggatataagtattgaaacaattataggcttagtgaatacgcaattagaatcaggaacacaatttacagtggagtcacaagcgctagttggaaatggtcgaacagacttgccttcttatgccatgccggattcacaactttatatgatggaaattaaccaagatagtctggagcaagcaaaggcctcgattcagtcagtattggatggaaattaaaaaaataggagaaaacatgaataatcaagaaatgaatacaatcgaaattgatattttactcttactgaaaacgatttggagaaaaaaattctttatccttctgatgggactattaggtgcagggttagcttttgcttatagtagttttttggtaacaccgcaatataaatcgacaactcgtatctatgtagtcgggcaacatgctgaagccggtgcgggattaacaaatcaggatttacaagctggttcttatttggcaaaagactataaagaaatcattctatcacaagatgtactgacgcagatagctacagagttgaatttgaatgaaaacctaaaagaaaaggtttcggtttctattcctgttgatactcgtatcgtttctatttccgtgcgtgatgcggatccaaatgaggcagcacgtattgcaaatagccttcgtacctttgcagcgcaaaagattgttgaggtcaccaaagtgagtgaagtgacaacactcgaggaggctgtcccagcagaggagccatcaactcctaatacaaaacgaaatatcatacttggtttattagctggtggtatcttggcaacagctcttgtactggttatggaaattttggatgatcgtgtaaaacgtcctcaggatatcgaagaggtaatgggattgacattacttggtgtagtgccagattcgaagaaattgaaataggagaacaatatggcaacgttagaaattgcacgtacgaagaaagaattagtaaataagacagaagaatattttaacgctatccgtacgaatattcaactcagtggggaagatattaaagtggttggtataacttctgtccaattaaatgaaggaaagagtacaatagcagccagtcttgctattgcctatgctcgttctggctacaagacagttctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttctacaaagtaagaattttgagaacttattagctactcttcgtcggtattttgactatgtggttgtagattgtccacctctagggatggtaattgatgctgcaattattgctcagaagtgtgatgcaatggttttagtagcaggggcaggacatgttaaacgttcagctgtgaaaaaagtaaaggaacagttggagcaaacaggaacacagtttttaggcgttatcttgaacaagtatgatattgcaactgagaaatatggtgattatggaaattatggtaattacggtaaaaaagcttgatttttatgatatgagctttgattaagtaggtgttagtatgattgatgttcattcgcatattatatttggtgtggatgatggtccaaagacaattgaagagagcctgagtttgataggcgaagcttatcgtcaaggtgttcgctatatcgtggcgacatctcatagacgaaaagggatgtttgaaacaccagaaaaagttatcatgactaactttcttcaacttaaagcagcagtagcagaagtttatcctgaaatacgattgtgctatggtgctgaattgtattatagtaaagatatcttaagcaaacttgaaaaaaagaaagtacccacacttaatggctcgcgctatattctcttggagttcagtatgaatactccttggaaagagattcaagaagcagtgaacgaagtgacgctacttgggctaactcccgtacttgcccatatagaacgatatgatgcactagcgtttcatgcagagagagtagaagagctaattgacaagggatgctatactcaggtaaatagtaaccatgtgctgaagcccgctttaattggcgatcaagcaaaagaatttaaaaaacgtactcgatattttttagagcaggatttagtacattgtgttgctagcgatatgcataatttatctagtagacctccgtttatgagggaggcttataagttaataacagaggaatttagcaaagataaagcgaaagcgttgttgaaaaagaatcctcttatgctattaaaaaaccaggcaatttaagctggttaatctagattttggagaaaaaatggatttgggaactgttactgacaaactgttagatcgcaacagtaaacgattgatactcatgtgcatggatacgtgtcttcttatagtttccatgattttgatcaggctgtttttggatgttattattgacattccagatgaacgctttattcttgcagttttatttgttttaatattctacctgattatctcagttagactaaaggttttttcgttaattacgaggtatactggatatcaaagttatgtgaaaataggactgagtttgatatccgcttattcattatttttaatcatttcaatgattctatggcagacctttagttatcgtttcatcttagtgtccttatttttgtcgtatgtaatgctcattactccgaggattgtttggaaagtcttacatgagacgagaaaaaatgtcattcgaaagaaggatagcccactaagaatcttagtagtaggtgctggagatggtgggaatacttttatcaataccgtcgaagatagaaaattggattttgaaattgtcggtataattgatcgtgatccaaataaacttggaacatttatccgtaccgctaaagttttaggaaaccgtaatgatattccacgattggtagaggaattagctgttgaccaagtgacgattgccatcccttctttaaatggtaaggagcgagagaagattgttgaaatctgtaacactacaggagtgaccgtcaataatatgccgagcattgaagacattatggcggggaacatgtctgtcagtacctttcaggaaattgacgtagcagatcttcttggtcgaccagaggttgttttggatcaggatgaattgaatcagtttttcaaagggaaaacaatccttgtcacaggagcaggtggctctatcggttcagagttatgtcgtcaaattgctaagtttacgcctaaacgcttgttgttgcttggacatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatacaatccacatgaagcagtgaagaataatatttttggaacgaagaatgtggctgaggcggctaaaactgcaaaagttgccaaatttgttatggtttcaacagataaagctgttaatccgccaaatgttatgggagcgactaaacgtgttgcagaaatgattgtaacaggtttaaacgagccaggtcagactcaatttgctgcagtccgttttgggaatgttctaggtagtcgtggcagtgttgtgccactattcaaggaacaaattagaaaaggtggacctgttacggttaccgactttaggatgactcgttatttcatgacgatacctgaggcaagtcgtttggttatacaagctggacatttggcaaaaggtagagaaatctttgtcttggatatgggcgagcctgtacaaattttggaattggcaagaaaagttattctgctgagtggtcatactgaggaagaaatcgggattgtagaatctggaatcagaccaggcgagaaactctacgaggaattactatcaacagaagaacgtgtcagcgaacagatttatgaaaaaatatttgtgggtcgcgttacaaataagcaatcggacattgtcaattcatttatcaatggattactccaaaaagatagaaatgaattaaaagatgtgttgattgaatttgcaaaacaagaataaagaaagtaaaagatatttttactttcctagagtttaaatgagatttaaattctaggaaggttgaaaaactttccagaggtaagatatgttaggtcataggttagtaagagaaaaagaaaataggatcaaaggtggtctttaccataagattcaaatcgagctggctttcaactcaaaccacattgaaggcagtcaactgacgtatgaccagacaaggtatatctatgagaccaatacgattggttttgaagaaaattcaaccataaaggtggatgatattatcgaaacgaccaatcattttacggcttttgattttctcttagatagctttcaagatgatttgaatgaaacttggataaaggatattcatgctatcttgaagagaggaacctcagattctcggaagttatggtttcaagtcggagattataaattatacccaaatgaagtcggcggtcgtgaaacgactttgccagaaaaagtagaatccgatatgcaagaattgctgaacagctatcaccgcttgcctgagacttcctttgaggatattcttgactttcatgttcgatttgaacgcatccatcccttccaagatggtaacgggcgagtagatcgattgattctgtttaaagaatgtctcaaacatggacatgtcccctttatcatcggagatgacatgaagtatttttactatcgtggcttagccgagtggggagagcagaatggtttcttgctggatacttgtctagcagcacaagatagatttaagcagtatttggagtattttagggttgaggattagtggtaacttgcaattaggagaatgaatgcatagcggaagaactataacaaaagaatatctaaaagcgaatgaaataacaggtcagtattttgataaaattgaaacaagaaagtttgaattatttttaaaatacactacagataagttgttagcactaatcctattagtattactttcgccagtcatcattgctttatctatttggataaaactagacagtaagggacccgttttttaccgtcaagaaagagttacaagatatggtcgaatttttagaatatttaagtttagaacgatgatttctgatgcggataaagtcggaagtcttgtcacagtcggtcaagataatcgtattacgaaagtcggtcatattattagaaaatataggttggatgaactacctcaactgtttaatgttttgactggtgatatgagctttgttggtgtgagaccagaagtgcaaaactacgtagatcagtacactgatgagatgcttgcaaccttacttttacctgccggaattacttcaccagcaagtatagcatataaggatgaagacattgttttggaaaaatattgttctcagggctatagtccagatgaagcctatgttcaaaaagtgttaccagaaaaaatgaaatacaatttggaatatatcagaaactttggaattatttctgattttaaagtaatgattgatacagtattaaaagtgataaaataggagattgatatgacaaagagacaaaatattccgttttcgccaccagatattacccaagctgaaattgatgaagttattgacacactaaaatctggttggattacaacaggaccaaagacaaaagagctagaacgtcgactatctgtatttacaggaaccaataaaacggtgtgcttaaactctgctactgctggattagaactagtcttacgagttcttggtgttgggccgggggacgaagttgttgttcctgctatgacctatactgcctcatgtagtgtcattactcatgtaggagcaactcctgtgatggttgatattcaaaaaaacagctttgaaatggattatgatgctttggaaaaagcgattactccgaaaacaaaagttatcattcctgttgatctagctggtattccttgtgattatgataagatttataccatcgtagaaaacaaacgctctttgtatgttgcttctgataataaatggcagaaacttttcgggcgagttattatcctatctgatagtgcacactcactaggtgctagttataaggggaaaccagcgggttccctagcagattttacctcattttcttttcatgcagttaagaattttacaactgctgaaggaggtagtgtgacatggagatcacatcctgatttggatgatgaagagatgtataaagagtttcagatttactctcttcatggtcagacaaaggatgcactagctaagacacagttaggttcttgggaatatgatattgttattcccggttacaagtgcaatatgacagatattatggcaggtatcggtcttgtacaattagaacgttacccatctatgttgaatcgtcgcagagaaatcattgagaaatacaatgtaggctttgaggggactttgattaagccgttggtacacctgacggaagataaacaatcatctatgcacttgtatatcacgcatctgcaaggttttactttggaacaacgaaatgaagtcattcaaaaaatggctgaagcaggtattgcgtgcaatgttcactacaaaccattacctcttctcacagcctacaagaatcttggttttgaaatgaaagattttccgaatgcctatcagtattttgaaaatgaaattacactaccgcttcataccaacttgagtgatgaagatgtggagtacattgtgcatacaattgttaatattatttctaattttgaaagtggcaaacattgaaagaaaaatatcaaatattatttaatccaagtgcaaatgaaattgagcaagtagttgcaatacatcttgccacatttgaaggtttttttctaacttttttagggaaaggctttttaaaaaacttgtatactggttttttggaacactcatcttcagaacttatgttaataactcaagacaataatgttgttggttttttagcgtattctaaaaatataagtgcattttataaatggttactgaaaaataaattttttcaatttttgtggtatagttttggagccactattcgtaaccctaaggcgagtatccgattacttagagctcttacttatccacagaaaagtcaaagtgaagacagttatgttgagctttcttcaattggagttaatcctgattatactaatcatggattaggcagtattcttattactgaatttgttaaaagacagaatttttcggaaataaaatatatcagattagcgacagatgcaataaataatgataaagtaaatgctttttacaaaaaaaatggctttcaactatacagtacatatttcacaccagaaggtcgcaaaatgaatgaatatagatattatggggatgagacgtgaaaaaggcattaataatttcaactgtaagtagacaattttatctttttgaacaagtaaatattaaaattttgaaagagcttggttatgaaatacatggggcggcaaatttttctgacaggagtgaacgattgaaggaggttaatattattgaacatcacgttgaattttcaagaaatcctctttctattcgtaatatttttgcatttaaaaaactacttttaattatacgtgaaaataaatttgacttaatacatgcccattcacccgtaggaggtgtatatggaagattggcggctaaaatttgtaatgttcctcggataatatatactgcccacggttttcatttctttaaaggagcacctcaacaaaattggttaatatattatccggtagagaaacttatgtcttatttaacagatgtattaatagttattaacgaggaagattataaattagcaaagagcaaatttaaacttaaacaaataaattttgtatcaggtattggggtaaactattctaaatttaaacctatttcttttgaaaaaaagattgaaaaaaggagacaatttggttttactgaaaatgatcaaattttaatatatgttggggaattgaaccatggaaaaaatcaaggcgttctaatcgaagcgatgtcagagattgtgaaaaaaaatccaaaagtttcattattattggttggacaaggaaagctcttttctgaatatcaagaaaaaatacataattataatttacaaaataatgttcatttgcttggataccgtgatgatgttgttgatttattgcaaatagctgatattgcaatatcaagctcattgcgagagggcttaccagtaaatttgttggaggccatgggggttgcccttcctttgcttgtttcagattgtcgtggaaatcgtgatttagtgacagataatggcattgtgatacacgataatatagcgaaagaatgggaaaagacaatattagatctttttgattcaccgtcaaaattgagagaatttggtttgaatagtttgagtcatgtaaaagatttttcggaagaacaaattagaaaaaaaatgctggagatttatactgattaagtatcatcattcttaaactttgggaagattgatgagttacaggaactcagcagaactacttttatctgaattgttctgaaaaaataataaataatttcgggggaaagtgatgagtaaaatcagagttatgcatttgcttaaaagcaatcgatattctggtgcagaaaatgtggtatgtcaaataattgaatcgacaagaaatcaatcaaatgactatgaaatgatatatgtttccccaaagggcccaattgaaggaattttggaagataaggatattaatttctttgggttaaataattttacacaaaaagagataggacgtgctatagatttattaaatcctgatattattcatgcacatgattttagtgcaagtgtccgagtatctaagtataacagaaaaattatttcccatttacataataatccgacttggttttccaaattagattatagaacattgatttatacatttagtattcatagattcaagggaataataggtgtatcgagatcaattcaaaatgagtacatttttaagaataaattgaataaaaaattcttggttctgcctaatgtagttgataaaactaaagttttaaatttagctaatgaagagagctattcatcggatttattatttgtaggtagattatcaagagaaaaagatccactgttttttttacagattgtaaaaaaactagttgagtcaaatcctaatattcaagctattatggttggagatggagctttattaaatgaatgcgaagaatatattgtttctaattcattatttaataatgttaaaatggttggttttgaacaaaacccatataagtacatgtcaaaaactaaaattcttattatgacttctgtatatgaaggattcggtttagttgcaattgaagcgatgttattagggaagcctgtagtttgtagaccagttggaggattggttgatattttagataatgaaacgggtgcgttttgcacaacgattgatgaatttgtatttacaataactcaattactagctaattctagtgatattaaacttcgtgaaactaaggctgtcgaaagagcacaaaggtattgtgatatttcatcttttcaacaaactttagatactctttataaagaaatattagggttgggttgatttatggttcgaagcatgaaaaaaaattatggtttagagtttatatttttactttttggaagcggaatgattttctatcaattattccctccgattgttatatcgttaacaagtatggctttttttactttttgtttttacagtttaaaagctaggtatagtgttattgaaacattggtgttgctgaccattattgggattccaacgtcaatgatttctattttagggattagttactctatttttcctcttacttggtatactacttttatattatgctcaatctttttaattatactaactggtaaattaagaaaaagttatttcttatcgataacattttttgctatcatagaatttacattgtgtttgatggcaaatagttttacagatgctatgaaacaatacttaatgattatatcgtttttatttgttttttttattggggaatatttaaaagtaaatgttaaaaacgactgtttttataatgacttacgttttttgtatttaataggagttttttgtgtcgcaaatcaagtattgtttcaaaaattttatattttaataacaggaagtgttatcggacactatattattatagggcaaagcagggttgcgtatggcgggattatgggagactttagttttgcaaccctgtaccttgcatcaggctgtttactaattctgttattatatttaaatgataaaagatttaaattttggttgttttttatttctgaaagttttttgttactttcaatgcttgttgtttcttcgcgaactggtattgtttctttggttattacagttgtgctttactttatttttaattttaaaaaaatacctaagcgcatgcttgttgtactagctttgggttgtacaggagttccgattcttattgataaaattttgtcctctagaggaggacaagccttattagaaacatctggtcgatctgaaaattatttgcaatcgattactttttggttagagaagcctttgtttggttatggattaggattagaaaatttatatcactctaccggattagcagtgcctcataatttttttatacaatatttattacaaatggggcttgttggattgtttctaattattataccattcatcatttttattacaaatgatgtcttaaggaataattatagcaagtggttgtttttattagttgtaattggttcgatgtttattcctgatatagtgagttctagatttttatacggaatcgttttgttgtgtacgattgagaatcggatgttcgactataataatttggaggtattaaaaagtgaaacgtaaggctgaattggttgctattaaggcaaggaattattttttggcaaaaaaatataagagagcaacttttttttctacagttttgagagtggtattttcttgcgatttaccagcagaagttcaatttcatgagtcaattcagttggtacataatggattaggttgtgtttttcacccaaagacagtcatcgcggagaattgcaaaatatatcagaatgttaccttaggtggaaatggtaagattataaacggggaaatcataagtggcgcacctaaattagaaaaaaacgttgcggtctttgctggtgcttgtgttttaggacctattacaatcggtcatgactctatagttggtgcaaatgcagttgttactaaaaatgttccacctcattccttggtaattgggaatcctgcacaagttaaagaattgaactttgagtataattttgaataaaggtaataaaatgagtagttttcacaaacaagtaggaaatgctttgaaatggtcatcgcttgctgagatagttgcaaaacttataactccactttctaataccattcttgcaagattattaactccagagcattttggcgtcattgcaacaattacaatgataataagttttgctgatatatttagtgattctggctttcaaaaatacttagttcaacatgagtttgaaagtgagtatgaacttgataaggcagcaaatgtagcttttagcagtaattttttgatttcaatatttttatggctatttatttctttattaaatgaacaaatatcttcaattgttggaaatcctggcttgggtattgtaattatagttgcaggtttctcgttaccaataacagcattttccagtatccaaagtgcattatttaaaagaaagcttgaattcagagttttattttatgcaagaatattatcgtcgctagtacctcttttaattacagttcctttggcaatgcttggaaaaagctattggtcaataattattggtaatatcattgggaatatcataatatcagtagttttgtcttatctttctgactggaaacccaatttttcttttaatagatttattttctttgaaatgttttcctttagtacatggtcattgttcgaatccataggaacttggctttcttcttacattggtacttttatagttggaagtattttaagtcaatattatttaggattgtataaaacaagcatgactacagtaaatggaatatttgcaataattacttctgctactgtttcagtattgttttcctcattatcaaggctacaaagcgatagaactgagtacgattttatttacttggattttattaatttggtttcgattgtaattttcccaactggagtcggaatatatatttataaaaatttagtaactagtatacttttaggaaaacaatggatggaagccacgagttttgttggaatatacggactaatgtgctgtataacgcttgttcttggacaatttgcttcagaatatttcagaggtttagggaaacctaaagcgaatgttttgatgacttttcttcatttgattgtattaataccaacattgattttgagtgctgaggatggctttctaactttggcatatgcaagttctttgattaagattcaacagatacttatttattggttgattctttggtttggttttaaatttaatccacttcgaatatttaattatgtctggaaggggttattttcttcgttgattatgggaatattcggatatatatttattcagattaatagtggcattatatatcagttcatttctattgtagcttgtgttattatatatttaatgtgttatatttatatttttaaaggtaaactggaattaattcggataatgaaaatcttcactggaatttgattagagtatactagaagggataataaattgataaaagtgttacattatacaccaggattccacggcggtggtatcgaatcaaggttgcttgattggtatagaaatatggatagagagaaagttcagttcttcttaataaaattaaaccaaatagacaacactgaagatattaaagaatttttatctttaggtggaaaattctttaatttacccccatttaacttgactactggattgagacttgaaaaaatgatttacaatattatagttgaggaaaaaatagatattgtacatgttcatgatactaattcaggattgtttgcattgaaggcagcaaagagggcaaatgtgaaatgtagaattttacattctaggacgactaattttttacccaatgaaaggaataaaataattaagcaagcgtttatgaaaatcgctcccaaatttgctacagattattttgcatgttcttttaacgctggtatttggggatgtggaaaaaataatgctgatgagatagttgttattaagaatgggattcaggatgatagataccaatacaatagtgcaattcgtatgagtataagaaaagagttaggaattgagaataagtttgtagtaggaaccgttagtcgactatctcctcaaaaaaatataccttttcttattaaaatatttaatgattactataaaatagataataattcaatattattaattgttggtggtggtgatgaacaatctgtaatagatgaaataaataattatcctgaaataaaaaacaatgtaattatagccggacctaaaaaaaatatttgggattattatatggctatggatattttttgtggcacatctttttatgaaggttttggaacaactgctatcgaagctcaagcatctggactgccaacccttctttctcaggggtttccagcagaaatcgaggtaactaactttgttaggagattggatatagtggatactgaggagtggattcgaaatattaaagaatttaagaatgaaagatattcagaaagtggaataaagtcaatagctgcatatggttattctgctaagaaggtagcaaaggatttagagaatttttatttggagcattataatgaatttaattaaatacaattatcaaaatagaatatcgtatattgatttatttaaagggtgcggtattttattaatgataatggggcatgttggatttgggcatacttttgaaaaatatatccacgcatttcatatgccaatgttcttttttatatctggttttttattcaaaaaaaaaacaatggatttttccaattggattattaaaaaaattaaatctctaatacttccgtatattttatggggagttatcagtttagttgtttggtatgcgtttaaaggtatagactggaagtattttcggattctattttgggacaatacgagtgggattgctatctctggtgcattgtggtttttgatggcgttgtttatttcagacatcatttttttcttggtagaatataacgtttataatacatttattaaattaattatttatatatttatttctagccttggcatttcacttcctttaatgggactaacattaccatttgctatttgttcggcttgtgtaggaacaagttttatggcgataggttattatataaaaagtaatgagattattctgagaaatttcttcaaattgaataccatatatatatttagttcttttttaattggttcaatacttgtaacatttaatgagacagttaatatgaggacaagtaattatggtaacatatttttgttctatacttcatcgctattaataatattggctctactttattattcaagaaaaattgataaatacttaaaaatttgtcccctgctcgtaattggttcggattcaattacttttgtatgcctaaatcaaatttgtatttatgctataggttttttgtgtaacagatttggcttaaaatgggatggtttattttttgatttcctctttttaataatagtattatttattttatggattgtaaatgaattgattatgagatcaaattttaaatgtttgatagggaaatagtttaaatatagaaactaataccatttttatcgggaatatgtgcaagaaaattaattttcaattatggaaattgcaaacgtgattttacctatgtagatgacatagtagaaggtgttaaacgtgtcatgtttggcgcaccgcagaagagaagcggaagtgatggtctcccaattcctccatatgcaatttataatattggcaatagcaatcctgaaaacttattggattttgttcacatattgagtgaggaactagttttggcaggagtattgccagcagattttgatattgaagcacataagaaacttgtgcctatgcaagcaggagatgtaccagtgacctatgctgatacctctgatttggagagagattttggttttagcccctctaccacactcagagaaggcttacgccaatttgctcaatggtataaagagtattacaaatagttttattttgctattggggcgatagccttttggacaaatgccataatttgtggcaggattagtaagaaaggactagtaaataacattcactaacttcgtgagatttgcatctggattttcctcttacattaaaaggagttaatcatgataaaagacattcattcgatttcattgttcaaacaaaatcttaatttggatatagtgccagaactgtaggaagatggataattttcatagttgattttaatttctttttaataatcattattttgatttttttgatgaggtgaaattatgagtaacaaagaattttctcaagaatttcttaaaactattattttttctaaaagaaaagagttaggatattctcagcaggaactttctgatttgacaggaataaatagggctatgattagcaagttggagcaaggggactatctaccgtcaattcctcagttgcttactttgagcaatgtgcttgattttgaaattaacagtttatttgtttctgattttccgaagtcaatcggcactcttccggcaaaaaaaatcgccgtcgcaggaacgggctatgtcggtctatccatcgctgttttactagcacagcatcatcaagtcacagctgtggatattatccaagaaaaagttgatttaatcaatgcaaagaagtcccctattcaagatgattatatagagaaatatctagcagagaaggatctcaaattagtagcaacacttgatgcagaaaaagcctacaaagatgcagaaattgttgtgatcgctgctccaacgaactatgatagtgctaagaattacttcgatacaagtcatgtggaagaagttattcaaacagtattatcggtcaaccctcaagctttaatggtaattaaatcaacgattcctgttggctttacccaatctatgcgtgagaaatttgctacggaaaatattatttttagtccagaatttctcagagagtcaaaagcactttatgataatctttatccatcacggattattgtatcttgtgaagatgatgcgccagattcggtagtagaaggttcaaagttatttgcttctcttctacaagagggggctttgaagaaagatgtggaagtgttgcatatggggtctacagaagctgaagcggttaagctttttgccaatacctatttagccttgcgcgtttcctacttcaatgaattggatacctatgcagagttgaaagggctggataccgagtccattatcaagggtgtcggcttagatccacgtattggtgaccactacaataacccctcttttggctatggtggatactgtctaccaaaagataccaagcagttgttggcgaattacaatgatgttccgcagaatatgatgtctgctattgttgaggctaataagacaaggaaagatttcattgccgatcaagtattgaagatggctggttattatgattattcgtcacatgatcaatattctcaatcgggagaaaaagaagtgatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacaccgtaaccgcccaataacaaggtatctatccacccactccctcctccagtatactgttagaaaaacaaaactggaggatttattatgtcacaccccatcattccattgactgttccccaatctcgccgctttgagaagcgaggcagaaacgatattatgatgaaaattcgtctcggaaaagtggagctcacagtctttcacactatcaatcaagaaacactagaaacaatcttagataaggtactgttctatgaccatccaactcagtgatttaggtcaagtttacttggtctgtggaaaaacagatatgcgtcagggaattgattccctggcctatcttatcaaaagtcagttcaacctggatcccttctccggtcaggtctatctcttctgcggaggtcgaaaagaccggttcaaagctctttattgggatggacagggattttggttattgtataaacgttttgaaaatgggaaattgacctggccaaacaatgaagaagaggtcaaggctctaacttccgagcaagtcgactggctcatgaaaggattttcggctctataatatctgtagtgggtaaatccaccatggaaattatggagcttttttgagtatagaaaaaagtcccatatgacctataatgaaaagcgacgaaactcacattagaaagggttcatatggaacaactaaatcttatcacaaatcttctcagaattaaagacaaaaatattgttatcactgatgaatatgatatgggaactcacttagaactccacggtcacttggattatacagcccctaaatgcccttcctgcaagggacaaatggccaaatacgatttccaaaaagcctccaaaattccctacctagaaacagctggttatccactccttatccgccttaaaaagcgtcggttcaagtgtaaagaatgtgggaaaatggttgtcgctgaaacacctcttgtcaagaagaaccaccaaatttctgtcgcggttaaccagaaaatcgcccaattactcatcgaaaatcaagcaatgacacatattgcacacaggctatctatctcaacatcatcagttattcgaaaactcaatgagttcaagtttgaaacagattggaataccttacctgaggtgatgagctgggatgaatatggcttcaagaagggaaaaatgagtttcatcgctcaggatttcgactcgctaaaagtcatctctatcctcgatggacgcacgcaagccacgattagaaaccacttcctacgctactccagacaggctagaaaccgcgttaaagtcatcactatggacatgtttagcccatactaccaattggctaaacagctttttccgcatgccaaaatcgtccttgatcgctttcatattgtgcaacacctcagccgtgctatgaaccgtgtccgcattcaaatcatgaatcaactcgatagaaaatcgcaggaatatcgtgctttgaaacgctactggaaattgatacaacaagatagccgtaaactcagcgataaacgattttatcgccctatgtttcgcatgcacttgactaacaaggaaattctagaaaaactcctatcctactcagacgaactccgacagcactatgaactctatcaatttctcttgttccatttccaagagaaaaactcagttcatttctttgaccttatcgaacaggaaatagccaatgttaatcctattttccagacggtatttaagacatttctaaaggataaagacaaggttttaaacgccatggaattgccttattcaaacgccaaactggaagctaccaacaatctcatcaaagtcattaagagaaatgcctttggtttcaggaactttgaaaattttaaaaaacggattttgattgctttaaacataaagaaagagagaacgaatttcgtcctctctaggtgttagcttttcgtctacccactacagttgacaaagagccggattttctatcattccaaaaataaatgtttcaaaaagtcgtgatttctattgaaatcatggcttttctttgtgtataatgagataaaaagaaggagattggttgtaagcgcccaataacaaggtatattgaaaaggctccaaagtcctgtcgactctggaacctttttctatttacaagctctcttaatatttttatcccatggcaaataggcttctaaaacctccttttttgcgagcgactcctcattaggtaagtgttctagaagataggtcatatatttttctgcatcaagtccgtgtcgcttagctgtttctaaaagactcaaaatgacagctgtcgacttggctccctcaaagctctgagaaaaaagccaattttttctgcccatcaccaaggtcttcatagccctctcagccatattgttggacaggactaggtcaccgtccgagagaacggctcggaaggtggtttcgtatttgaggctatactctattgcagtacccaatttggaagctggcaagacagcctgttcacggcaccaatcaaagaactcgtccatcaagggagttaactctgtctgccgtttatgtagccgttcctcagtagacaggtcagcccagtcactctccaaggcaaacaggcggtcgcaataggctaaacccttcgctcctaaagaagtattgtctgtcttcttaggagtcgcctcaaaaaattttcgtctaacatgagcccaacagccaacgagctgagccttgtctaattgacgataagcactccacatgtcacaatgaacgtagcccgcatagtccccaagaaactcctccacaactaagccgctccgtcgtttgtcatgatgatagagggtaattccatttttctcatgtttcccagacaagaaagtccagtagtaggtcaactggctatcattttctaagaccttgtaggaagtctcatccgcatgaagaataggctgctccaacaatttctcgtgcaacaggttataaatcggctcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacacttggttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagaaatcagtgtataaaattaataaatttgaaggtgaaatctatcagaagttaaataaaattcttgattcatataaccaagaacagaatagcctgataaaccttgctgcatgtattagctatccattcaccgaagtattaaagattcaaagtttccctctcgctactctgccaacagagggagctgttgaaaaacgcttttttcctcattgtacttcattggataatattgaagtatattcagaagaattgtgtcttcaactttttgatttaaatcctggtgattatagagttaatgtgcaaccacattcaggaactcaagctaaccaaatagtctacaattgtgttttagaaagagacgattatattttatcgttatctccaaaagacggaggacatatttcgcatacttatacaggtaaaggtactgtaaaatattatcacttagaccataacttaaatattgattatatcgaattaaaggaattattagataaatataaacctaaattgattattattggtgcttcgtcgtatggaaatgaatttaattatcaacaaatttatgaaattataaaagaggttagcccaaataccctcatcttagcggatatttgccacagtgttttatatattatggcaaagctacataagtcgatttttccatatgtggatttcgctacttttacaatggataaatgtttacgtgggcctcaaggaggagtactactgtatcgttctatatttgaagaaaaaataactaattcaatttttcctagaacacagggtgggcctacacaaactgcattatttgcgaaatgtatctgtttaatcaaattattatcaatagatattcaagattatgctaaacagattataaaaaatactttattgtttataaaacaattaagtaaagagggggttgatgttgtttataaaaaaccaaagactcatataattttagttaatctattgaatctaaacttgagtggtaaggaggcagagaatctactttttcagcataaaatattagttaaccgaaatcaaattccaaatgatacacacggaccaatgacgacttcaggaatgagattaggaacagttggaattacaaatttatcctatactgatgaagatataaaaaaattagctaaactagtagctaatttattaaaatataaacaatatgattattccatatatttagatctcattcacaagtaccatgaacaaattaatatctccaattaggagaaagacctatacagaaattatattttttgtatggaatcaacagatagtatttggtgagcccgtcttgataatcatcaatataagttttttcataaacaaaaggaatatcttcaaattgttgtaaattgtatactatttgaaatttataccaaggatcgtctatgagtggaatttctgcctcaaagctctttagtgaattttgaaattctgtaaaagagattttttcagaaatcaactcaataattaatttgtttaacttgagcatcctaatatctaaggtcaaagctttaggacattcttgaagtgatttatttataaattccagagattgttgataatttttattcatcagaaaaataattgatttattacaatatggttcaaaaatttcatttgaatcatatttttttagtattttttcggccttatttatattctctaaagctatatcatattgcccatcccatatattaacaacacctagattattatatactgttgcaacaggtatttgatattcattacgttgaaaatagtccaatgctaattcgagatttttggtagcttctttggttgggaaataatgagcagaatttcgtaaaataatataatagaagtcgtctttttctacagaattcatggtctcattaaggagtttaattgcatcttgatctttacctaaatgaccataagcatttaacttgtagagtaatgttccagagctattttctaacttttccagtgattttagtgcctcctcaaattcatatttttgaatttgaaatctaggatagtatagttgtaaatcttttgaataattatcttgttgaaggctatttaaaatagctaagcctccattgaaatcagaaatccactggtacgagttcaatatataatgtaagtatttttatggtaataattctattaaatgatgtatcttcttgctcaaagatgcaatgtaaaaatatgaatttttcctgtattctatttcaagtaactgtttgatatattctacattttgtcgtaactctttaatattacatatatttattaagcagtgaattaaataagctaactcgccaccaactcctatagataagatagtttgctctaaatatatttttagattgttggttactaattgaagatcagaagtatttgtgtgatttaaaatactatttacaattgattcgtgtgaaattttgattttatcatttgtatctccattaatatatacgaaacctgcatcaataagggattttagagaatcagctacttcaatattttcatctactatagatttaatgtaattaaaaactatatcttttctcataccagcaggaaaaattgatgatatgagaagtatatttttttgaatatctggaagtttgtcatatatatcagaaatattaaataattctgaatttggattatcaataagtctgttaataatcaattcaatctctttatagttaccttgtgttatctgccagatttgattcaatttgatattatcaagtaaagcaattttatttcttattagtaatttacactcatcctcagtaagatacgataaatttaatacagtaggagtataattgtccaatgtatctagtttatcaattgattttaacttatcagttgttcggtttataatagttaaggagactccgctttgaagtgtattaaagtcatcttcaaattttatttttatatcttcagataaaaattgataattatcaataataatattcagacggattttttttgaaacatgactgaaatatcttaaatataaatcactttcaaatattccctcctttatttcagtaacaacttcttcccaaggataatcaattacttttttataggttgtatcgaatgaaatcaaagatctgattaacctaaaactatgctatgtttcagagttagatttgttagtttttgttttcttaaataatttgaaaatgaatatttttgaggtattgataagcatagatttcttctgaattgagttgggacatacgctccttttagtagattttcaaaaaatttattactttcaaacccgtcatttgtaacatcaatgtagagaataaacgcttctttatcatgactgtaaacttgttgacaaacctctttgattaactcggttttaccactaccacttaagccattaataatatataaactatttttatcattactggaaaatttaaaatgctgttttaattcttctatttcagtatcgcgaccgtaatacataaaacatctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaac

SEQ ID NO: 53 - DNA, 32882 bp, Streptococcus suis
tacttgttataatgatgacgattttacgaaataaggatattgagatgaatacagtattgtttcaagctcgtgctaatcgcttgattgaagacgttttgaaagctttccaacttgacaagagagggaccatggatgagtttcgattggaaaagcatttacaagaaattttgcaggtgttgaatgagtcaacagatatcaatcggctcactattcgattggaaaaattttatcaaaatgcaagttttctgatcggattgggggacgttcaattaagcgaagcgactaagcgagcgtggcgtgcctatgaccaatttcactacgaccaagtaaaaccccaactactccttcacggaaatacgagattagggtaattgccaactattcagttattagaaaactcacaacccttggaaatcaaagggttgtcttttttatgctataattataggtagaaagaggtgtcatatgacctatatccaagtgaaaaatgaaggcaaattctatcaaatgggggaagccctgattattgcgaacaaagatgtaacctttgacattgagcaaggtgagctggtgatgattctaggctcatcaggcgctggtaaatcaaccttgctgaatattctaggcggaatggatcaagcagatgaaggggaagtgctgatagatggggtagatattgccaaattatcaagccatgaattgaccaattatcggagagatgatgtgggctttgtcttccaattttataacctagtagccaatttaactgccaaggaaaatgtagaattggctgcggagattgtgaaagatgctcttgatgctgaagaagtcttggaacgggttggtttaggacatcggaaggacaattttcccgctcaattgtcaggaggggagcagcaacgtgtggccattgcgcgggctgtggcaaagaagcccaaattactgctctgtgatgagccaacaggagccttggattatcagacaggaaaacaggtcttgcaaatccttcaagatatgtctcgaaaagaaggcgcgacagtcatcattgtgacgcacaatgcggcactcgctccaattgcagatcgagtgattcgtatgcgggatgcacgaatccattcaattgaaactaacccgagaccacaggacattagcagtctagagtattaggagaaactatgaaaaagaccatctattggaaggacattcgacaatccatgttgtcctccaaagggcgatttttatctatttttagcttgatgatgttgggctcgctggcactgacaggattgaaggtaactgctccaaacatggagcgaactgcacaggcatatattgaagccaatcgaaccatggatttggctgtcatgtccgaacttggcatcacccaagacgatgtgaaagagcttcaaacgattgacaatgcaacagttgaggcagggtatttcaaggatgtagttctggaagaagaccatcaggctgttcgaatgttttcaaaaccagaagagttatcccagtacaccttagtggagggaaattttcctaccgaagaaaatcagatagccttatctccttcacttcaagcaagctatcagattggagatacttttagcatcaaagaacctgacaaaaatggtacagtgctaaaagaaacagcgttcacagttgtaggttttgtagcttcttctgagatttgggacaatgtcaccatgggaatggctagtagtggtacaggacagctgacaggctatggggtcgtattgccatctgtcttccaatcagatgtctatatgattgcacggatttcctatgatgatttagcaagtctttcctatgccagtcaagcctatactgaaaagctggaggaccataaaaagcaactggaatcggttgtcgctgataatgatgaacagcgaattgccagcattcaagcagatggacaagaggaaatttcaaagggagagcaagatattgccaaagctcaacaggaattagcagacgccgagaaggatatccaagaaggcaatgcccagctggcaacaggtcgggaagaatttgcgcgtggaagggctaaaatcatacagtctgaatccgagctgagattagcatacgcaactttacttgacacaaaatctcgcttggaggccagcaaacagcaattggatgaatccaagaaaaaattagatcaaaccaaatccttcttggatgcgagcgcagctgaactctcacaatccgctcagcaattggaaacagcccaacaagaattagacaaacaaaatgcccaattaaatgatcttggtgccaccatttcctcaggtagaaatgcatggtttcaagagcaaaatgaacttaatacccaagtagaaagtcaagtgcaggaaggtgaaagtttatctgactatcctgaattgctggcgcgccaagaagccctagatactgaaaaggcacgtttggatcaattggaaaccgaatttgagcaagctcatgcaggctatcaagctggttttgacttattacaatcgaaaaaagccgaatatcaagcgggacaaaaacaatatgaagcgtggaatgtggaataccaatcaggccttgcacaatataatgctgggttgaccgaatacgaaaatggctacgctgcctatcaaaaaggtgttgctgattatgaatggggtgtccaacaattgcaatcctccagcctgaccctcaaccaagaggaactcagactcaatcaggcggacgaagcactaagcaaggcaagtcaggaattctccactcaaaaagcccaagctgaaaaagaaattacagcagctcagagcgaaattgaagacgctaagacagagttgagtaagattgaaaaatccagttatcaagtctacacacgctcgaccttgcccggcagtgatggctatgtaacctatcaaaatgccaccaaatccatcgcagcggttgggaatgtcttccctgtcgtcttatatctggttgctgccttggtgacctttaccacaatggcacgatttgtagatgaagaacgcacccaatctggattgtttaaagccttgggctacaccaataaacaaatcatggctaagtttgtcttgtacggactaggcgctgggcttgcaggggctatcgttggcatcatcttgggaaatacagtcctatctccacttatctcttctattatcacagagacaacggttatcggcgcatccaccttgtatttctacccactgtggaccagtctagccatcggcttaacgctcttatccgcggtgctacctgcctatctggtcgcacaacgcgaactctttgaaaaaccagccagtctcctcttacccaaaccaccagtatcaggctcaaaaatccttctggagcgctggcgctttgtctggtctcgcctcagtttcacccacaaggtgacagctcgcaacatcttccgctacaaactgcggatgctgatgaccatctttggcgtggcggggacagttgcactcctatttggcggcttaggcatccgttcctctatctctggtgtcgtcgaccgacagtttggcgacctgatccattatgatatgttggtggtggaaaatagcaaagcttctgaggaagaactagatggattgtctgattttctacagtctaaccaagttcgacagtccttgcctgtggcatttgaacaaataacagaaaaaatcacctcaaatgaccaagaaaaaacagtatccatcagcctctatatcacggatagaccagatatgggacgtttgatagagcttgaaaccagtaaaggaaaagaactcactctaacaggacgaggcgtgattctgactgagaaactcgcacaattatatgatgttgccgttggtgataagcttaagttgaccctcaatgacaaagaagttgaagttcgagtagatggtattgctgacatgtatgctggacactttatttttatgacggatgaatactatcaggaggtgacgggtagcagaaaattagcaaatgcctatctagtcgaactcaaaaaggatagtgcccaacatgtccaagaagtatccagccaattattggatatgactgctgtcaaaagtctggtacagaatacctctctcatggctatgctaacgacaatggcagcctctcttcagagcgtcatgaccattttggtggtactgtccatcttactaggactagtaattctctacaatctgaccattatcaatatgtcagaacgaatccgagaattatccaccattcgcgtacttggatttcataataaagaagtaaccctctacatttatcgggaaaccatagccttgtccattatcgggattgtggctgggctaattggtggcttctatctccaccgcctcttgctctatatgattggatctgatagcatccgcttcaatccagaagtaggagtagaagtctatctcatacctatcttagcgattgtgggcattctagccttccttggttggtatgtcaaccaccaactgagaaaggttgatatgctagaagcactgaaatccattgattagtgataaacagacaagtaccttaccgttcgcttcaaatggtgggtgcttgttgtttaaaattgtcaatttcctgtcattttaaacagaaatacgcaaacgttttaagaggctagttgttcccgttcgggaaaataaaaatgtagacgtattcatcaccaaaaaaactttgttttacttgaataataggccaaattagtgtaccattattctaatagactttttataatcgtattcaattgagctggtgaatttaggagtatttatggattcaagaagaactaaacgtagtaagaaaaaaccagttttgaccatattaaattggggtctttttgtagtgtacagcgtttccgctgtttttttagcctacagtatttatcggtaccagatttttaactttcgtaacctcaatcactttttagtaggggcaatggctgtcctaggagtggttggggttatcctgcttcttaggaaaaaggcaaaaaaatggacaaccgtcctcctcattattggtatcgccctttctggatttggtatctggggagtacaaagcttggtacaattgggctctacagtcaataaaaatgctagttactctagctatgatatggaaatcattgtaccagcagacagcacgattagtgatgtgagccaagtaacgagcttgcttgctcccgttgacaatgacggagacaatatcaccaagcttttagatagcttacagtcagaaaaaaacgttaccttgacaccgactccaacagcctcttatatggatgcctaccaagccatgatggctggtcaaggagatgcaatggtcttgaacagtgtcttcttagaaatgcttcgtgcagaagatccagaggttgattcgaaaatcaaggtcttgtactctgtgaccaatgaaattaaaaacgaatcttcaagtacaaatcaagaaacaggtaatgccatcaatatctatatcagcggtattgatacttatgggtcaatctcatccgtatcacggtctgacgtcaatatcattatgaccatcaatcgggataccaaaaagatattgctaacaacaacacctcgggatgcctatgttaccattccaggagctggtcaaaaccaaaacgataagcttacgcacgcagggatctatggtgtcgatacttccgtccaaaccttggagcaactctacggaattgacatccattactatgcccgtctcaactttacttccttcttgaagcttatcgacgttgtgggtggggttgatgtagaaaatacacaagaatttacaagtttgcatggaaaatattatttcccagtaggacaggtacatttagactctgatcaagctttgggatttgttcgagaacggtactcacttgccaatggggataatgaccgaggtaagaaccaagaaaaagtgattgcagccttgattaacaagctgacccagtctgaaaacctgcttcattatcaggaaattatgcaatcactttctgactctatccagactgatatgcagttggaaaccatgatggagttggtcaaccaacagttggaaactggtggaaactttactgtaacttcacaagctgtaagtggaacaggaagtacaggagttctcccatcctatgccatgcctggatatgccctctacatgatggagctcaatccagatagtctggaacaagcaaaagcagcaatcaatgcgaccttagcaggtcaataaaacgatagaaatggaataattttggagcaatgatgaataaccaagaagcaaatacaattgaaattgatgtcttatcactattgagaacgatttggagaaagaaattcctgattctcttaacagctatactgacaactggcttagcatttgcctacagtgcatttttagtgactcctcagtatgattcaaccacacgtctctatgtagtcaatcaaagtagtgataacggagctggtatcaccaaccaagacttacaagcaggtagtttcttggtaaaagactataaggaaatcatcctatctcaagatgttttgaaaaatgtgaccactactttaggtattacagaagaaatcaaagataagattacggtgacaattccaactgatacccgtatcctgtccattaccgttcgtgacagtgatccgaatcaagcagcaaccatcgctaatacgcttcgtgatgaagctgctaaaaagattattgaggtgaccaaggtaagtgatgtgactactttggaagcagccctgccagctgagaagccttcaacgcctagaaccaagcgcaatcttgctttaggctttgtttcaggtgccttccttgcaactgccttggtgcttgtcctcgaagtattggatgatcgtgtgaaaagaccacaagatattgaagaaggcttagggatgaccttactaggtgtggttccacaggcagagaaattaaaataggagagaaacatggctactttagaattagcaagtaataaacgtggattaatcaagaagaccgaggaatactttaacgccatccgaaccaatatccagttgagtggctcagaattaaaggtcatcgggataacttcagtcgaagcaaatgaaggaaagagtacgactgcagccagtctagcgattgcctatgctcgctcaggctataaaaccattttgttggacgcagatattcgtaattcaatcatgtctggtttcttcaagcccgcgacaaaaattacgggtctgacagactatctggctggaacaaccgatctgtcacaaggcttatgtgatacagatgttccgaacttaacagtcatcgaatctggtaaggcttcaccgaaccctacagccttgttgcaaagcaaaaatttcgataatctaatcacaacgcttcgtcgctactatgattatgtcattgtcgactgcccacctttgggattggtcattgatgcagccatcattgcgcagaagtgtgatggtatggcccttgtcgcagaggcaggtcgtgtcaaacggtcaggggttaagaaagttgcagaacaactagagcaaactggtacgccatttttaggtgttatcttgaataaatatgatgtggctacggaaaaatatggagcctacggtaattacggtaactatgggaactacggtaaaaaagcttagtggtcgtcgtaatcaattccaaaatgtaggagcaacgaaatgatagacattcattcccatgtcatatttggtgtggatgatgggccgaaaacacttgaggagagccttgcattaattgatgaggcacggcggcagggcgttcggatgattgtagcgacgtctcaccgacgaaaagggatgtttgaaacgcctgagaaaatcatcatggccaattatctagaactaaaaaaaacggtggccgaacggtttccagaattgacactttgttatggtggtgaactctactatacaaaggatattgttggcaaattggatgccaagaaactaccaaccctgaatggtacgaaacaggtattggtagaatttagtatgaataccccttggaaggagatccaagaggcagtcaatgaaatcatattgttaggattaactcctgtgattgcccatatcgagcgttacgacgctttggcattcaagggagaaagggtagccgaactcatcgataaggggtgctttactcaggtgaatagcaatcatgtcttaaaaccaagcctgattggagatgttgccaaaccctttaaaaaacgtgtgcaatactttttagataatgatctggtcacctgtgtggcaagcgacatgcacaatctctccaaacgaaagccttatatgcaggaggccttcatacacattgaaaaagaatatggaagagatcgtgcacgggcattgtttaagaaaaatcccttgatgctactcaaaaattaggatataaatttgaaataaacgcgaaatgttgcctttcaataatttggtggagatgaaaaagtagtcaatggtatagaaagatatccattgactgtaggagatgaaatggtaaatattaatgaataccgacagtttagactggcgcttttagaattgattggggtagtattggctgtcgtcattacaacccaattgcctacctcaaagatgaatcagatagggattctattgattatggccctgcattttgtagctttttatttctctcgaatgtcgtcagaatttgagagtaggggctacttaatagagtttgaacgggtcgcaaggtacgttttaattttcgacatactcctcatatctttttcttttttgttgggagatagttttatcattacgagacgggggttggctttatttaccattcttacctttatcatcgtttacattatcaactgcactgtgcgtagatacaaatacctcttccttatgactgctgaacaacaaaagaatacaatagtcattactactacagagagattgcgattaatggagggtctctttgagtcagatcaacttcctacgaaatatttggctggtatagtagttatcggagacagtgatgtggcgtttccaaagggagtcccaataattccttttgatgatgcgattgactttgcgactcatgaagttgtcgaccatgtgtttatcaacttaccgagtgaacattacgatctcaaacatcttgtttccgattttgaagtcatgggtattgatgtgagtgtagatattaactcatttgatttcagggctttaaaaaataaaaaaatcaaacaagttggagaccatagcatcgtgacttttaactccaattactacaaacatagccatatctttctaaagcgcatgttggatatctttggggctgtgattggtcttcttatttgtggtctggtcgggattgtcttagcccctattattcggaaagatggaggaccggccattttcgttcagaaacgagtaggaaaaaacggacgtatctttaaattttataaattccgttctatgtatattgatgcagaggaacggaaaaaagaacttatgtctcaaaaccagatgcagggtggtatgtttaaaatggataatgacccacggattactccaattggtcagtttatccgaaaaacaagtctagatgaattgccacagttttataatgtgctagttggtgatatgagtttggttggtacacgtccaccgacagtggatgaatttgaaaaatatacaccaagtcaaaaacgtcgcctcagcttcaagccaggtattactggactatggcaggtaagtggtcgtagcaatattaccaactttgatgaggtggtaaaacttgatgtcgaatatattgataactggtcgatatggtcggatatcaagatattgttgaagactatcgtcgtggtttttaaaaaagagggaagtaagtagtctttgattaaggatacattatttcaaagatagaaaataggttatatgaaaacaatatatattattggctcaaaggggattccggccaaatatggcggatttgaaacctttgtagaaaaattaacggaaaatcaaaaaaataaaaatattaagtatttcgtggcatgtacaagggaaaattcaaaaaaatctaattttagtgaagatttttttgaatataatggcgcaacatgtttcagcatagatgttccaaatattggtccagctaaagcaattgcatatgatattgcagcattaaaaaaagcaattgagattgcaaaaacaaatggtgacaaaggacctattttttatattctagcttgtcgtatcggaccatttatttctaaatatcgtaaagaaatccatcaattaggaggtcaattattcgttaatccagatggacatgaatggttaagggagaaatggagtgcacctgttcgtcgttattggaaagtttcagagtcattgatggtaaaatatgcagacttattggtttgtgatagtaaaaacattgaaacatatattcaaaatgattacagcaagttcaatcctaaaactacttatatcgcttatggtacagatctagaaaaatcgattttaacatcaaaggacagagtagttcgcgaatggtttaacgaaaagaaagtcagtgaaaataattattacttagttgtaggtcgctttgttcctgagaacaactacgaatcaatgattagagagtttatgaagtcaaattcacaaaaagattttgttctgattacgaatgttgagcaaaatgctttttatgaaaaactcagaaaagaaactggatttgataaggataatcgtattaagtttgttggtacagtatataaccaagaactactgaaatacattcgtgaaaatgcttttgcttatttccatggccatgaagttggtggtacaaatccttcattactagaagccttgtcttcaactaagttaaatcttctcttaaatgtcggttttaacagggaagtgggggaagatagtgcaatatattgggaaaaagaggatcttcataaagttattgaagaaagtgaacgattgacacaaggtagaattgatgaaatggataaattatcaacgaaacaggtaaaagaaagattttcttgggactttattgttgatgagtatgaaaaaatatttgtattataaatacaaaattatttttgttctaaagtgaattgggagtgtttgatgaaaaaggcagtggtagttggtggtagtaatggaataggactatcaattgtaaaagagttagttcaattagagtattttgtttacatattagatattgttgaaccggatcttgatggatttttgaatagagaaaaaattgaatttatttatacagatctttctcaaattaatccaaatgtttttctccaattatcaaaagatatagaaataaattttcttatgattactgcaggttttggaagggttgcaccattttcttcaataagtattaaagaaattcgggatatttttagtgtaaatactattgcaggtattgagattattaagtatttttatcatagaatacattcagagtcttcattttatacaggaatgatggtttctatagcaggacttatttcgtcaccgttatttgcaacatatgccgcatcgaaagcagctctaaataggtttattgaaagcgtaaatatagaattggaatcagaaggatataataatcgaattctgaatgtatcacctggttcaattaaagggacgaaattcaatgggggagacaatgattcttcacagacttctaaattagcaagtgaaatcattaaacgggtaatctcacaaagtgatttatttattccagaatatactgaaatatataaggatgttttgcagagttatcacttgaatccgcatcaattcggtttggaaagttatcgctataaagtgaattccaatcgattatcagatgaaaatagagaaacaatcaaaatcgggtatttgtctggaacatttgatttatttcatgttggacatttaaacttgtttaaaaatgcaaagaaaatctgcgattacttgattgttggtgttcatccagatgcttctcataaaggtaaagaaacctttataccatttgaagagagaaaagaaattgttggatcgaataaatatgttgataaagttgtaacatcaactgaggaagatcattccgcatgggacctgtaccactataactatctgtttgtcggaagtgattataaagggacgaaacgattcaatagatatgaaaaatactttgctgataaagatgtggagataatatattttccttatacaaaaggtacaagcagtactcaaatacgaaacatagtttcaaaaagtaataaaaaaggtttggaatagtgatggagttaaatcctctacataaggtagatttagaaattgtaaaagaagtcattaagatatgtgaagaaaataatttatcatactatgctttaggaggcacaatgcttggagctatacgtcataagggttttatcccgtgggatgatgatatagatttgggtatgcctcgcaatgattatgagaaattcttagaaatagcaccatcgcttttatcttcacatttgaaagttgtgaattataaaaatacaccagaatatcattactatatcactagagttcttgatactactactagagtaatagaagataggattggtaatgaaaataagtatacgaatgcttcaatcgatatttttccaatagatggaacgccaaataatattgtcttaaggaaaatttattatttaagagtaatgtatcatcgggccttaatgtcgctttgttacaaagattcgatcgataggaagcggaaaagaaattttttagaaaaagtgctattggcaattcttgaattgataccaattgaaaagatgacaactcctaataagcaaaaggagaagatagatagaatgctttcaaaacaagatattgtaaaatctaattttatcggcaatattatgggagcttatagaactagagaaattgttccaaaagaatggtatggtaagggcacaaagtacccttttgaagatattgagttagtaggtttagataattatgatgagtacttaaaatttacttacggggattatatgaaacttccgactgaagataatagaaagactcactttagcttggtaagcgatgaggtgggggatgattaaaataataaaaatagattctaagaaattgttttatttattattaatactaagttgttcagcaatttacggattgaattactggttttctgatgtatatactactgattttatggtaatctcaacaatgattgtatctgtattttcagtcttattgcatcataaaataaatttaggtacttattatatattgcctattctattaaatttactaatgtggatttctgggataatcgttgcctttgagcatgaattgcaactttctacaatattaaaagaaagttattttactattgcacctgttattatttatatttcctaccattctataatcagaaataaatataatatagtctcatttcttaaactaataacaatatcatcaattatatgtaatctaatatcaatgcttgaatttgctttcgcattatatggtactgaccttctaaaaattaatgtattttcaaaaatgagaaatggtacccctaggtttattattggggaagttattataatattagcgttttttctctcatattctattttaatcaacagtaataaaaatatcttaaacaataagttacatttagcaaatgtggttttaactttacttaatttagaatttataattaaaacgagaactttatcactgtacgtattaataacaattctagttgtatcgttatttaataagcaactaagtagaaatgtaaaaatttttattgccattatttttttattttcattgattatcgtaattaattctaatattatgtattgggttgaagatacaattaataatgattatggtattcagatgagattttatgaaattgaatattatgtaaattattttaaaaataattggatagcaggagttggatttctgtcatcaagtagtaattcgtccacatataatgttgtgatgggaccttatggtaaatattatacgagcgatgtaggaataatcgggttgctttttaaaaatggtattattgggttgttttggatttttagttggttctatacaagtattaaaattttattaaaaaatatgaaatttataccaaactactatagtatgttcatgaaaatgatagtagttttctatctgatttcatgcattaatttaatttttactgatacaccgaggtttccttatatagcgcttgggatgataattattgaatctagtggtttttttatcgaataggctactgtattattttcgattagtatagctaaagttttattttataattgagtggtataaactattatttcgagaaaatgttactgaggataatattatgtgaatgataattaagtttattctattacttattattcaattttagtgcttcctctggtgttttatttaacaagaataactagtattgaattatacgtgtatgaattctattaaaataataatattaatacgttactatttttgtggaattacattgaagtaattactattaataaggggaaatttctttatgaaaattgcaatattaatgtctacatataatggagaaagctttttagaagaacagatagaaagtattttaaatcaaacgtgttcagataatatcactctgttaatacgagatgatgggtctactgacaaaacagtttcaattttggaaaattattctaaaaaaaataaaaatattaaatatactgttggaaaaagtgaaggtgcagcaagaagttttattaccttgttgaaagaaaatatgggatatgatttttatgctttttcggaccaagatgatgtttggaacagtgataaacttcaaagagggttgtctaagataagatctattaatcgacctgcactctactgttctaattgtgaacttgtggatgaaaatttaaaaagtctaggtagattaactcatcgaaaagtaccaacttataatttagtatcaatactatgtttgaatagctgtgctcagggttgtacttcaatttttaatagagagttagctgagattgtccaatataataatctcccagaaactattattatgcatgattcatttataacttgtctatgcgcaatgatagggggagaaatagtgtatgatcataactccacaatgaaatatagaatgcataacaacaatgtttttggtatggtaacgttaaaacagaactttgcaaaaactataaaaaatcgatataaagaaattacaacgaaaagaaaaataagcatgagtgatcaagtggacagtattttaaatgtatttaacccatatgttagccaagaacataaaaaaatttgtgatatcgtggtcaaagcgaaattttcaaaattagataggttaaaactgttttttaaccctgatttaaaacatgataccttgaacaagactcttacaaaaaaattagagattttactcggaaatggttaggaaagaaaatggattatcaattaattgtttcaacaatgaatcaaaataatgatgatttaataagaagaatgaatattagatctaatgcaataattattaatcaatctgaaaatgtaagttttcatgagaccatcataaatgaaggaattgtaaaatggtatgaatttgctgaaagaggaatcggtttaagtcgaaatagtggttttatgagagcagaagctgagattattcaatttgcagatgatgatatgtattttacagacacctataaagaggatgttttaactgaatatagaaatcatccagaagcagatgttattttattttctaacaaatgtcttaataaagataggatgccttatcaagttgataaatttggtccagttggaagaactgaagctgtaaagtttggaggagcacgtataacagctcgtagagagaaaatactctataataacttatctttttctttgctttttggaggaggggctaaatatggtgctggagaagatgtaacgttcattcaagattgtattaaagcaggtttaaaggtttataaatctccaatcattgtttctactatggctcaagattcatcaacatggtttaatggttacgatgaaaagtattataaagataagggggcgttattagcaatgaatttccccagattaagctattttggcagttttttattagcttataaaaaaagtagacattctaattacagtttcaaagaactcttgagtttttatcaggaaggaattaaagattttaaaagtcataagtaattactagtaatcgggagaggttaagtgatgaaaaatagagtattcaatactggtgagacacctgaggatttaaaaagaatctataactatgatggaagtacactcaggaaagcccagcttcgtatgattgagatgttatcttttttagataacatctgcaaagaaaataatattacatatttcttggcttttggcactcttttaggtgcaaaaaggcatggaggtttcataccctgggatgatgatatggatgttttcatttcatcatcagaacttaaacgtcttcgtaaaataattaataatggggattatcaatttgttatacaagataataagattgataaaggtttcgtacgctactataatgtattgagagatttaaattcagagtacattaaagatgaatttgtgcataatcagcgcaaatatcgtggggttcaaattgacttgtttccctatgattatggagtaatggaaagtggtaaaaagcttattggaatgacaatgggttttaatgaaaaatttttattagggaagtatccttttttatgtagtttgttttttaaaattgtaagaaattttattatccccttatttagattttttagtaaatttagaggcaaaaagtatatctcgttaggttacgagggagtaagtttaggctatacatacctagccgaggatattttcccattaggtaaaatagagtttgaaggtcttacagttccagtccctaataaaatagaaaaaatcttggttgtagattatggaaaaaactatgactttttaccagacattgatgatagaaaccaacatagagtactggatataaaattctataaataaataatatttatttatagaggtctagcttgtcagtttgaaagaacttatattaattgtttatcttattatgagaaaaaatatcaactaagactaataagtttagaaattttattgatttctattatgaacagatgcaaaagaaaattttatttaacaaacatagaaagaaactaagaatttatttaataagttaagttttatcaatgtatattgaatactatatcaaacaatgttaccttatttgataataaggtagaagggttaatatgtgtttggataatgtgccattcatgaagagacttcttccttttatatgtctaaaatcattattttatagcacgctccttttcaccaaaattactcataggattgaattaattaaaatgaatacaataaataataatggaaaatctttaagaaataatgctattctgagtgttattaaacaactattttcaattttgttcccaataataacctttccatatataactcgtgtattgggagtagaaaattatgggaaatatacctttagtgtatctatagtaaattatatctcttatatagctgctgcagggatattaagatatgcgataagagagtgcgctcgagttagagatgatagagaaaaatttcaaaaattagtaaatgatatttttacgataaatgtatttactactataattgcattctcagcgttattgttgttatttttgcttattccggaactaaaagattatattccatatatcttaattattagtctatcagttttgtttacaacaattggcgtagattggattaatagtgcatatgaagactatttatttattacagttaggtatatatttacacagtttctgtcaatgatactattatttcttttcgtcaatagtgcgaatgatctgatgatgtattcatttattagtgtttttgggggaatagttgctaatatattgaatgtaatacatattaaaaggacattggggtattatcccaaaataatcatttctaactctataaagaaacattttaaatccatattgtatctttttgcgagtacaattgcaacatttatttatatcaattctgacatttcaattttaaaaatattttcagatgatcaatcaattgcatactatggagtatccacacaattttatcagttaattaaacagttaataaatgctgcttttttagtagtcatacctagattttcaaatgatttagttaagaagaataaaacacaagttacaaaaagctacaatactattttaagtcttacaattttggttataatccctagtgctattgggcttttcatgattcgtgaaaatttaatattattattttcgggtaaattgtatttgcctgctgcgaattctttagcaatcttatcgttctctttgattccagcgatgttagctaatttttttattaacattattatggtcccattaagacttgaaaagcaagttatgtttgctactgtatctagtgctctttttaatattatatttaattttatactaattcctaagtattcagagagtggggcagctgtgacaaccttatttgccgaaattattatggtattaatagccttatatttttgtcgtgatttacgtgtaacaattcctataaaggtgattgttactagtttaattggtggtattggcatctttcttatttgcgacttttttaataatttcgacttctcaagttttataaatattttactaagtatttcatttagtattggttactatttgttcgtaatatttattggatttagatctgatctgacctcaatatttagaaaataaaattttaaattgtttaatcaattaattttgaaatgaaatgcttatattcaaaaaatgaaagtgtcttgaacaaatgaatcgttataatatccttacaaaaaatgcgataattcttgcggctggttttggaatgcgcatgattccaataaatattgaaacacccaaagggttggttgaggtatcaggtgtcccgttgattgagcgattgatctgccagttacatgatgcagggatttcagatattacaattgtggtgggttatttaaaggatcagttttcgtatcttgaggataagtaccatgtgaatttggtttataatccagagtactctgaaaagaacaatttacattcgctaactttagtttctgaaaagctatctaacagtttcatacttccttgtgatatatggtgcaaagataatccatttaaaacagcaaattcaggtacatcatggtatatggtttatgaggatagcaatgaagaaataggtaagcctttctggaaagctatgactggtattgcttatgttactgaagaacagtctgaaaaaatgaagcaacgcctgcatttattagattcagataccatgtatcaagattcgttttgggaagaagtactgtatgataataatgtatttttgccattaccaaaattagtaagtaaaaatcaaatccatcaaattaatacttttgaagatttgcgtgtaattgatgaacaatctgaacatcttcaatcagatgctattgatattatttgtaaatcgcttaatgttaaaagtgaggatatatctcaaattactgctttaaaaaaaggtatgaccaatcgctcatttcgattcacttgccataataaaaaatatattatgcgtattccaggtgaagggactgatttactgattaaccgtagagaggaagcagaagtttataaggcattagctaaatatcagattagtgatgatattatttatatcaatcctgataatggttacaaaattacagagtttttatatgaggctcgtaattgtgatgttggaaataagaatgatttagttaaatgtatggataagctgagaagtttccataaacttgaattagtcgttgaccatagatttgatatttttggacaaatactattttatgaacagctgagattagggaattcctctgtttatcctacatacgagaatgttaaagtagatgtatttgcattgaaggaatatattgaaaagcacgttgaaagtgaagtgttaactcacattgatgctgtacctgataattttttgattgttgaaaaagatggtaaagaggacattagattaattgattgggaatatgcgggaatgcaagacccacatgtggatgttgctatgttttgcatctatgccctttttagtagacaagaggttgatgaattaattgacatttattttgaaggaaaaaccacggaagaaattcgtatgaaaatttacgcttatattgctgcgtgtggtttactgtggagtaattggtgtgaatataaaagtacattgggtgttgaatttgggaattactcaattgcacagtataaatatgctgaagagtatagccagcttgtgctagattatatatcatagtaattcacaagtcgtagttttgggaggatttattatgaataagaatgttaagggaatattttggggtttaacatctggaatgttttggggtttagatacagctttaaatggatttgttttattagcttcaccatttattctatcagatactcgtcttatttcaggtaccttgttactcgcattttttcatgattttatttctgcaattattttaacactagatctactcgtacgtaatgaacttagaggaatttttaaaattttaaaaacaagaagtgcccatttcgtcattttagcagcattatttgcaggtccacttggaatgagatcttacctttacgctgttgatgccattggatcagggttaacagctacaatctctgccatgtatcctgcagttgccgcagttttaggagcaattttcttaaaagactatttgaataaacgcggatggatgggtcttgttttaacaataatagctatttctattctgggttacagtaatttctccttaggaagtcaagtagtggttggagtttctgcttctttactttgcgtatttggttgggcttccgaaagtgttattactgcctacggaatgaaagaggatgtcgcaccaaaacaagcattattcattagacaatggacttctagtttggcttatcttgtatttatgttttttgagggaaatgtcatatttagtattagtgcagtgacaacttcacccatatttatcttgatttgtgtgatgtcagttattggaacattatcgtaccaatgttactactctgcaattaatgaaataggaccggtcaaggcaacggggttaaatgtaacgtattcaatttgggcaattatattttctttatttcttttaggaggaaatatagaaattaaactcattttcagtggtttactaattataattggttcatcattgatgataaaagaataaattatactaaaggagaaaaaatgagagcaatcatattggctgcaggaatgggaacacgcttaagacctataactctaacaactcctaaatctttgattgaaatcaatggtgagactttaatagagagacaaattcggtttttaaaagaaaaatcaattaatgaaattgtagtagttacaggttatctagctgaaaaatttgattttttaattgaaaagtatggtgttaccttagttcataatgaaaactttgatgtttataataatttttatactatgtatttagtcagagattatttagctgactcttatgttattgatgcggacaactaccttgttgaaaattttattgattcaaatattcaacaatcaacttattttagtgcttttaaaaaaggatttacagatgagtggcttttagagtgtgaaagtgataataaagtaaaaagcatagttgtcacaagtggtgagggaaccataatgtctggggtttctttttgggataaagaaacaggtgagtatctgagcagagttattgaggactatttttcagttggtaattttgaaaatttatattgggataatttagttatggataatttagataaaatctcagtttatttaaagcgtattccttcagaatctatctttgaaattgataatctaagtgatttagaaaaacttaaaacctatctttctgtgtaggattaaagtggttaaatttaatcaacccataacaaggtaactattcaacttgacaattcaccgttatggtattagaaaaatgagtacattgataaattgatcaaaagtaaagtcttatttagttccacttttttgttgaatttaaatgaatgtaagaaaagattttctaatggagattggtcgaactaactttttttatctaactagcgtaagcgcccaataacaaagggctctttgtcaactatagtgggtagatgaaaagctaacacctagagaggacgaacttcgttctctctttctttatgttcaaaggtaaccgcccaataacaaagtatattgaaaaaggctccatggacatgtcgaccctggaacctttattattaagtagttgctataaataactttgtaatagaaataagaataaattaactttagacaaaacttataaagtacaccatttacaattaaaaaataaattgaatttttcttttaatacattaggatatgtattttgatatgttacaatagtgatatagtataactatgaaagatggaatttaatgaaaatcaaagaaattaaaattaaaggttttaaaaaatttaaagaattgaatgtggaatttaatgatggtatttcagtgatagtaggagaaaatgaaagtgggaaatccagccttttgttagctttagatgtagtcttaaatcaatctatttttaatcgctcaaattcagcatttgatagatatctaaataaggaagaagttctgtacttttttgaaaaccctagcaaagatacacttccaagaattgatattgaagtttttttagattttggaaactctttgaaggcatcagaattttctggattgcactacaataaccctaaaaacaatgaattttattgtggcattaagtttgaatatggttttgatatggactttttgaatgatatcgacatttctgaatttgcctataataaggtggttccaatcgaatatttccgttcttcatggaccacattccaggggagaggttataagcgtcagctactttcaagtaatatcatttttttggataattccgctcaaaagtatgacttatttggtgggtatgcaaggagcctttatcaagccaaagtagattcggtaacacatcgacagatagcttctaaatttaagcaaagccttcaaagttttattgttgaccagaaaacagaattagaaattgacaataagaagcatattggatttgactccagcaagactgacattcttaaattaattgatatttatgaaaataatgtttcaattcaagatatgggaaaaggtaaggagaacctaataaaaacagaagtatctctatcaaatggaatatttgatgttatttttattgatgaacccgagaaccatctaagctttaccaatacgagaaaattaattaatttactaaaacagagaactgctgagcaagtgattgttgtatctcacagttctttggtggtaagcagacttgatttaaaaaatgtaatttggttgtcagacaatgaaataaaaaagttagaaacattagatagtgaaacatcaatgtatttttcaaaaattgataacttggatattttaaggtttattttggctgaaaaagtaattttagttgagggagctgcagaatatattgtcaccccagctatttacgagaaagttgtaaatagtagacttgaatcagatggtattgaaataatttcgatgggaagtatttcctacgagagatatcgcaaaatcgcagagtcattaaataagaaagttgcagtaattactgataatgacggaaaagataaacagtatgctaatacggatttatttagtattttttctgatcttaatcgtgataattggacgctcgaagttgctttttataataaaaacatgaagttttttgatgaaaaatataaaaataaaaagacgaaggcagaatatgagggcaaaacaatggccaaagcgtgtgcgcatatgttgaaaaataaaacagaaaatgcgctactaattgaaaaagagattgactcactttctcttccggagtatttaattgaggcggttcaatggataaaagaatagtattggcgtccgcaggtgctggaaaaacgtattttattgctaatgattttcccgataaagagcgagtatacctaattacattcactcatcgaaatgttgagaatattcgtaaggaattattaaagcgatttaacggagtaattccagaaaatattcgaatttcaacatttgattcatttgtttataaccaattaattcgcccttttgaacctgtagctaattttccaggcataaaaagtagaggagttgaggtaaatattgaaccttcaacagactctcgtgattatggtgcctattttaaattggataatcctaagcattttttattaaatgataaattctatgtgacaaggttaagtaaattttttatgaaacagggtcgtgattttaaaaagaatacacttaatagattgaaatatttttgcgatacgatttacatagatgagtttcaagattataacggctgggattttaagcttattgagtatcttatgaagtcgtcgggaaccaatattgtagctgttggtgacatatttcaaagcttggttgctaatatacgaagagatggtaatggctcaaaccttccgtttgcagcaatatcttctgttgatgatttagcccgaaaattacccaaaaaagtcataattgacacaactactctaataaaaagtcgtagggtagctccgaaagtttgcagttttataaatgattctttaggtattcctatcgaatccgcatctaatagtaacggagaaatcaagtggctaaataatatttctgaagctatacccgtattgatggactctaatattcccaaattggtctgggataaaaggtttaaatgtccaggtgtgagtaattttatcaattggtcttactcaaagggcgatacttatctaagaacttgtataatattgaccgaatcaaccagtagtctatcgaattgggatactctatccaatcctgtaagaaataggctatatgtagcattaactcgttcattgggggatgtttatttaatttccagtaatatttttgcggaatataagaacagcatataaattgtgggtatagattaatcttaattttggactgctatcctcactatggtataatcttcatatgaaaaagattagtgatttaggtttaacgggtcgaaagctggttggtgagggactgattctagttatcataggtattggctttctgattgctggctggcaatttccagggttgattttgcgttttattcacgctgggttattcttcttagctctttatgaattgagcatgattttcttcagaaagaagaagtcaaatgaaagtattttagctttggtgggcaaggctgttttatttggtattctagctagtattgacttggccgttcagattcccttgtattttgcggcgatatttattggtatataccagctgtttacagcggtgattaattttatcacattttacttatataaaaaagatgatgtgcagccgagaattcgttttttaatggatggaatctggttgtccattctaggcgtggcgtctttgtttgtttctgggactcaactagttgtccagaccgttatcattgggagctaccttgtgttatttggattgaccaatctacgtgatggattcatttttgaagagtcaattgaacaacagagtctcaaacgtcatgtgagactgactttgccattatttattgcggctctcgttcctcgtatgaccctacaaagagtcaacgactttctagcagacaataaagatcagacagcacaggcagtctataatcgtcataaagacatttctgttattccagctttagaagtatttgtacatgttggtgaagaaggttttggggctgtagggcacgttgatttgagttacaaagggcgggtctatggctatggttcttatgatgtcttgtcggaacgtctgggtggggcgattggtgatggtgttttatttaaagctgagcgccaagcctatattgacttctgtacacaagagggtatgaccatgcttggttaccagatggtgttgagtcctgagcaagaggcagctattgaagaacggttggatgagattgacaagctgttggtgccttggaatccaagttctgaaaaagtatcaaaaactgcagatggacaagcgattgaaatgtacgcctatcgtatcaaagaagaaatcgatgctgagttatttaaatttagaaaatcgaaattcaaaacctattttgtcttatccaccaactgtgtcctcttggcagactctgtcatcgggcaagctggcacggacatccttggcattcgagggtttatcgcccctggcacctatcaaacctatctggatcaagaatatgaaaaaccacatagtatggttgttgctaagaacatttattatcgtaaagaaaaatcctagtttttgctaggtttttctatttgatcaggcatcctcataccgcacaatccctgatttcatgctataatagttctatggataaaaacaagttattattaattgatggctcttctgtagcctttcgtgctttctttgcactctatcatcaaatcgatcggtttaagagtccgactggtcttcataccaacgccatttatggtttcaacctgatgttggatcacatgatgaagcggattgagccgactcacattttagtggcatttgatgcagggaagacaactttccgaacagagatgtttgcggactataaggcaggtcgtgccaaaactccagatgagttccgtgagcaatttccctttattcgtcagatgctggatgccatggggattaagcactatgagctgaaccagtacgaagccgacgatattatcggtactttggataaaatggcagagcggacagacattcctttcgatgtgaccattgtcagcggtgataaagacttgattcagctgacggatgaaaacaccgttgtggaaatttccaagaaaggggttgctgagttcgaagaatttacccctgcctacctcatggaaaaaatgggcatcacgccaacacagtttattgacctcaaagccctcatgggagataagtccgataacatccctggggtgaccaaaatcggtgaaaagacaggtctgaagcttctaaccgagtttggttccttggaaggaatttatgaacatatcgatagtatgaaggcttctaagatgaaagaaaacctgattgcggataaggaacaggcctttctttctcgaactctagcgaccatcgatacgcaggcaccgattgaaattggtttggatgatattgtataccaaggtccacggattgaggagttgggtcagttttatgatgatatgggcttcaaacagttacgggcccagctaggcacgacgaactcgcaagaggaagaagtacaggcctttcatatcgtatccgaagtcagctctgctatgttcaaaaaagaccaattcttctactttgaaatcttgggggagaattaccaccgagaagaggtagttggtctggcttggggggacaaggatggtatctatgttggtggacctgagctcttggatagtccggtattgaaggattttctggaacaccagcctatcaaaacctatgatttcaagcgtggcaaggttttgcttgctcgtaaagggattgatttaccccctgcaacctttgatagccgactcgccaagtatttgctttcgacagttgacgacaatgcgctgacaaccatcgcccatctctatggtcaaaccagcttgattcctgacgaggccatttacggcaaaggtgcgaaattggctctgcctgagcgtgatgtattcttcccacatttggcccgcaaggtgcaggtcttgatggagacagaggcaccgatgttggccaagttagaggaacaccagcagtccgatcttctctttgagatggagttgccgcttgctaatgtcttagccaagatggaaattgctggaatcaaggtaaaagtagagaccttaaaagccatgcaggctgaaaatgaagtcttgattgagcagttgaccaaggaaatctatgagttggctggtcaagaatttaatatcaattcgcctaagcaattagggactattctctttgaggatatgggcttgcccttggaatacaccaagaaaaccaagacaggctattctacagctgtggatgtcttggaacggctggctccaatcgccccagttgtttcaaaaattttggactatcgtcagatttccaagcttcagtctacctatgttatcggcttacaggatgccattttagaagatggtaagatccatacccgctacgtgcaggatttgacgcagacaggtcgtctctcatcgacagatccgaacctgcaaaatattcctgttcgtcttgaacaaggtcgtttgattcgtaaggcgtttgttccttcgcttgaaaatagtgtcctcttggcatcggactattcacagattgaattgcgtgtattggcccatatttctcaagaccaacacttgattgaagcctttcaacagggtgctgatattcatacgtcaacagccatgcgtgtttttgggattgaaaaggcagaggatgtgacgccaaatgaccgtcggaatgccaaggccgtcaactttggtgtggtctatggaatttctgatttcggtctttccaacaaccttggaatttcccgtaaagaagcgaaaaactatatcgatacctattttgaacgtttccctggtatcaaaaactacatggaaacgatagtgcgtgaagcccgtgataagggctacgtagaaacgctctacaagcgtcgtcgggaattgccagatatcaactctcggaatttcaatgtccgtaatttcgcggagcggacggccatcaactcaccgattcagggttcggccgcagatattctcaaagtagctatgatcaatcttgataaggtactgacagaagctggtctttcgacccgtatgctcttgcaggtacacgatgagattgtcttagaggtgccaatggcagagctggaaacagtaaaaactatggttaaggagaccatggagtcggccattcagttgtcagttccattgattgcggatgaaaatgaaggtgagacttggtacgaagccaaataagctaaaggaagtaaatcgatgaagaaatcacttgtactgatgggattactgagtttgtttctcactgcatgtggtggtaaggaacaaacgagttcaagtcaacagtcgagttcatcaggagaagaattctcagccaccttgcctattttacaggagaaagaagatacaagtaacgaaaagttagatgtcttggccaatgcagaaaccattgtcgtcacaccaaatcctccagcggatgagacgcaaaaaggccacaagattcatgcggccaacaatggtgtagctgaacaggatgaaaatggaaatattaaagagtattttcgttattacgatgttccatcaacatggacgattaatgtggaaaacaccgaagatgagactctgatggctgtctatgatgtgaaggaaggggccagtacctttatggttcagctctataatatcaacgccttcaaccaatctccattagaagatggccgcaatatgaccatggacgagctggccgaacgcatgaaagagaccaatcacgattttttagaagaaacggttgtgacgattgctgggcaagagtggcaggttggacgccagattctcagtgaccaaaaattggctcgtttaactttctaccgtatggaatctactggttcttatgatgattctgttgtggttggtgcaatatattattcgctggatcctggacttgatacggatcgcactttgttgaaaaaagctataggtcaattgaaggatgttgtttaccaaatatctaaaaagtagcatttattgttccaatacccaaggccattccattaaaggagaattacatgacgtacgcatttgaaaatcctagtcaggatactattttcaactatcttaaagaagctaaaaacatcgcggttgttggattatccaatcgggaagaaacagtagcctatcgggtttctaggatcatacaggacgctggttatcggattattccagttaatccacggtctgctggagaaacgattcttggtgagactgtctatgcaagtctcaaagatattcctctttccatcgatattgttaatgtctttagacggagtgaatttctcccagacgttgctcgtgaattcattgaaacagatgctaagattttctgggctcaactcggtttggaaagtcaagaagctgaggaaatccttcgtcaggcagggcgagaccagattgtcatgaatcgctgtattaagattgaatatcaaaagatgattggagaataaattcatactcttcgaaaatcagaagaagaccttgttgacttattttcattgagtatcagtttcggtgaaaaaaatatagtcgaatgaattagctttcagacaaggaactgaggtgcagacagtactattgtacggcaaaccgaaagtgacgatgtatcaaagttaattcaaaagactacaaaagctatagaatcttggtgaatccctcttaaggggaagaggccagttctatagcttttttactttttcattgcaaaaaaccgagcacgcttggctcggttagtggtttatgattgtcagatgcttttagttgattgctgcaagaagggcatctgcttgttttgcaagttgagcttcatcaacaggtgcgccaattgttgcaagagtgaattcatcaaccaaagaagtacggataaatggaagtagtttgcggtattcaacagctgcttcgtcttggtgtgcaaatgatgagattgatacagtaacaactttttcgttgattgctgaaacaccacgtgtgtcagaaagatcgagtgaacggctaagccagtcaagaaggtttcttactgaacctggaatgccagcgttgtatactggtgagaaaatccagatagcatcagcagccaatactgctgcacgagctgctttaacagctgcaggtgcatcagcttcaagatcttgtgagaatacaggaacatctttccaatctaagtaagaaacagttgcttttccttcaagtgctttttcagcagattttgccaattcagcagagaaagcaccctcgcgaagagaaccaactaaaaataatacatttgccataaagataatagctccttaaaataatttgatgttattagtatactctttttatcactagttagcaatagttttgaacttaatttttaaattttttcaaaatttcagctagctgatcttgctcttcctgactcagaacggaaaagagttcccctacatgagcatagtgatcaggtaggattttctcaatggtttcccgtccataaggtgtcagaccaattcgaaaggctcttctatccttgcaatcgatggttttggaaatgtagccttctcgaatcatatttttgatgaccactgtcatgtttcctgatgtgctcagcaatttatcaattaggtcctgaattctcaagtcgcccttgttgtagagtgcctccaatactccaaattgggcaactgtcagtccatattttctgatggtttccatttctttttttgaaatcgtatttgctgctcttcgaaaaacgacaaggctgtgtaaggcatgtttgttttcgtttaatgatttttctacgctattcatacgaatattttagcaatatttacattgattggcaagtgatttcctaaaaaatagaaaggtatacttgaatattttttgtaaaatttccatttgaatttctagaaaaaatagcattgcagggtgatttgtagtataatagggatactatggaaaaaaaattcagccgtctcttggcatttgctagtggccgtttgggtcaatgtcttattggtttttttgttcttgcattcagtgttatctttttaatcctctacgtttgggagcagtcttctcgtccttttgaggaggctagagttggggcgcaacagattgcacagcaatatgcggatgtgagtcaggtggatgactttgcaatctataatggtacggaaacttattatagcttgaaaggtaaggataagaacggagatgaggtatacgtgttgataccaagtgcttcgtcctctatttatgtctatactgttggggcagggattacaaaggaagaagcgcaagcgattgctcaggagaatggtgcaaaaacggctgatcgaaccattctaggctatagggatggtaaaccgatttgggaagtcaaatcggggacagcctattatttggtggattttgaaacaggtgactttgtcaagatggagggattatgagagatcggaagagcgtcgtgtagggaaagagtgtagatctcggtg

SEQ ID NO: 54 - DNA, 32279 bp, Streptococcus suis
atgtttgtctgcaatctgaaacgggactttttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcatgccatttctttttaaggttgctggaagtccgttcgtaataaatctctaaaatttcttcttttgacttataattgcgatagaaagcgttgcgagaaactcccgctttacgaaccaattcagatactgaaatttgcttgagctcctttttctctaggagaaatagcagagcagtttctattgattccttagtcagttgattcgcttctttatttgattgatagaggtttttcaaagattggggtgaaattttacgacctgtcatagttttccttttccgagtgtcacatctgaaagaaaatgctttcagatggggtagtttaatgatataattgtaagtaaatagagatttattgtcaaataaaaaagtaaaattggaaatgagaatattatgacaaaatggaaaattgttgcagattcgggctgtgactatcgtcaattagctaatctagctccgaacactgaatttattagtgtgccacttaccatccaagttggagaacaagcatttgttgatgatgcaagcttggatattgatcacatgatggaggtgatggaagcatctaagtctgcagcggggtctgcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcattatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaatactcaatgaaaatcaacagtagcctaggaaacgaagtcgaagatagaactctgttactatcttatttcaaggtaacaggctgaaaacctccactggagcttttcactcatcaaggcaagttgacaacggataattttgattttcgaagagtataacaattttggaatgtagtttccactatatagaataatccccctcgtctcttaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggagaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagcgagagagctttttgcatgataagattggtatcgtagtcgattagacttttatgtttgatgaaggtatcatgtagctgattaggaaggctgattgcaccgattcggagggcaggaaagagcatcggtgtaaaagattttatgtagatgacacgattatctgtatcaagatagtgtaaaggtaggctatgactagagtcgaaatccgccaaatagtcatcctcaatgatgtagacatcgtattgctttgctaattttacgatagctgtttttgttgctatatcataggttgaaccgagagggttgtgcaagcgaggaattgtgtagaaaaacttgatttttccagtttggaagatactttccaattcttctaggtcaattccatctaaatcccgttcaattgtttgataggggattccttgatgtcgaatgagctctatcattcgtgaataggtagggttctctatcaagatttccgtttttccagcccaggtttccatttgtgtgagaatatatagagcttgttgactaccagctgtgataaccagctggtctttttttgtatagacatgatagtccattaacagactttgaacggaggaaatcaattctgctaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtactttaattccaacatagccttttggacagtgtctttgctacaatgatattgctcactgagttgacggatagaaggtaatttctctccacgtttgaatcggtgttcctctattccagtcaaaatatcttggataataacttgatattttttcatctaggccccctttttatagactatgttactagctagtatataggaaaaattgaagaaagacaatatctggatggggttgaggttcaggaattaagctactatatggtataattaagtgatgaaaataattatacctaatgcaaaagaagtaaatacaaatttagagaatgcctcgttttatcccctgcctgatcgaagtaagccggtactggatgccataagtcaatttgatgtaaaaaagctggctgccttttataaattgaatgaatcaaaggctgagttagaagctgatcgttggcatcgaatcaggacaggtcaagcaaaaacctatccagcctggcagttatatgatggtctcatgtatcgttatatggataggcgaggtatagattcgaaagaagaaaattacctacgtgaccatgttcgtgtagcgacagccttatacggattgattcatccttttgagttcatttcacctcaccgcttagattttcaagggagcttaaagataggcaatcagtctttgaaacagtactggcgaccgtattatgaccaagaagttggtgatgatgaactgattttctcactggcttcgtcagaatttgagcaggtgttttctccacagattcagaaaagattagttaaaattcttttcgtggaagaaaaagcaggtcagctaaaagttcactcgactatatcaaaaaaaggtagaggaagattgctgtcctggttggctaagaacaatattcagaaattatcggacattcaaggttttaaggtggatggctttgaatattgtactgaaaaatcaacagagaatcagctgactttcatacgttcagttaaattatgaaaaaagaacaagataatgtttttcaggttttcaggtaacgtttttcatcactaaatatagctatgtcgctagtaaaagattgttatttgtgatacaataagtaagttataagtaaaaggaaggttgtttatgaagaagagaagcaggtggaggaaatcgcctaagctcaagttggtaaattttgtgctttggggactttatgccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcattcttacttattttttcactagtcatcacttccgtcggaatctatggaatgcaagaagttgtaaaattttcaacacggctaaattcaaattcgacattttcagaatatgaaatgagcatccttgtcccagcaaatagtgatattacagacgttcgtcagcttactagtattcttgctccagccgaatacgaccaagataacatcactgctttattggatgacatatccaaaatggaatctactcaactagcaactagccccgcaacctcttacctgacagcatatcaatctatgataaatggtgagagtcaagcgatggtcttcaacggagtttttaccaatattttagaaaatgaggatccagacttctcttcaaaagtgaggaaaatatatagttttaaggtgactcagactgttgatacagctactaagcaggtgagtggagacagttttaatatctatattagtggtattgatacctacggtccaatttcatctgtttcgcgttccgatgtcaatatcattatgactgttaatcgtgcgacacataagattttattgacaactactccacgagattcatacgttgctatcgcagatggcgggcaaaatcaatacgacaaattaactcatgctggtatttatggtgtcaatgcctctgttcatacattagaaaatctttatggtatcgatatcagtaattatatccgtctcaactttacatccttcttgcagttgattgatttagttggtgggattgatgttgaaaatacccaagaatttacaagcggagggtataatttccctgtggggacagtacacctagacgcagagcaagcgctaatctttgttcgtgagcggtattcgttggctaatggtgataatgaccgtggtaaaaaccaagaaaaagtcattgcagccctcataaaaaaattgagttcaccagagaatttacgcaattatcaagctattttaaatagtttagaagattctattcaaacggatataagtattgaaacaattataggcttagtgaatacgcaattagaatcaggaacacaatttacagtggagtcacaagcgctagttggaaatggtcgaacagacttgccttcttatgccatgccggattcacaactttatatgatggaaattaaccaagatagtctggagcaagcaaaggcctcgattcagtcagtattggatggaaattaaaaaaataggagaaaacatgaataatcaagaaatgaatacaatcgaaattgatattttactcttactgaaaacgatttggagaaaaaaattctttatccttctgatgggactattaggtgcagggttagcttttgcttatagtagttttttggtaacaccgcaatataaatcgacaactcgtatctatgtagtcgggcaacatgctgaagccggtgcgggattaacaaatcaggatttacaagctggttcttatttggtaaaagactataaagaaatcattctatcacaagatgtactgacgcagatagctacagagttgaatttgaatgaaaacctaaaagaaaaggtttcggtttctattcctgttgatactcgtatcgtttctatttccgtgcgtgatgcggatccaaatgaggcagcacgtattgcaaatagccttcgtacctttgcagcgcaaaagattgttgaggtcaccaaagtgagtgaagtgacaacactcgaggaggctgtcccagcagaggagccatcaactcctaatacaaaacgaaatatcatacttggtttattagctggtggtatcttggcaacagctcttgtactggttatggaaattttggatgatcgtgtaaaacgtcctcaggatatcgaagaggtaatgggattgacattacttggtgtagtgccagattcgaagaaattgaaataggagaacaatatggcaacgttagaaattgcacgtacgaagaaagaattagtaaataagacagaagaatattttaacgctatccgtacgaatattcaactcagtggggaagatattaaagtggttggtataacttctgtccaatcaaatgaaggaaagagtacaatagcagccagtcttgctattgcctatgctcgttctggctacaagacagttctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttctacaaagtaagaattttgagaacttattagctactcttcgtcggtattttgactatgtggttgtagattgtccacctctagggatggtaattgatgctgcaattattgctcagaagtgtgatgcaatggttttagtagcagaggcaggacatgttaaacgttcagctgtgaaaaaagtaaaggaacagttggagcaaacaggaacacagtttttaggcgttatcttgaacaagtatgatattgcaactgagaaatatggtgattatggaaattatggtaattacggtaaaaaagcttgatttttatgatatgagctttgattaagtaggtgttagtatgattgatgttcattcgcatattatatttggtgtggatgatggtccaaagacaattgaagagagcctgagtttgataggcgaagcttatcgtcaaggtgttcgctatatcgtggcgacatctcatagacgaaaagggctgtttgaaacaccagaaaaagttatcatgactaattttcttcaacttaaagaagcagtagcagaagtttatcctgaaatacgattgtgctatggtgctgaattgtattatagtaaagatctcttaagcaaacttgaaaaaaagaaagtaccaacgcttaatggctcgcgctatattcttttggaattcagtatgaatactccctggaaagagattcaagaagcagtgaacgaagtgacgctacttgggctaactcccgtacttgcccatatagaacgatatgatgccctagcgtttcatgcagggagagtagaagagttaattgacaagggatgctatactcaggtaaatagtaaccatgtgctgaagcccgctttaattggcgatcaagcaaaagaatttaaaaaacgtactcgatattttttagagcaggatttagtacattgtgttgctagcgatatgcataatttatctagtagacctccgtttatgagggaggcttataagttactaacagaggaatttggtaaagataaagcgaaagcgttgctaaaaaagaatcctcttatgctattaaaaaaccaggcgatttaaactggttactctagattgtggagaaaaaatggatttaggaactgttactgacaaactgttagagcgcaacagtaaacgattgatactcatgtgcatggatacgtgtcttcttatagtttccatgattttgagcaggctgtttttggatgttattattgacattccagatgaacgctttattcttgcagttttatttgttttaatattctacctgattatctcagttagactaaaggttttttcgttaattacgaggtatactggatatcaaagttatgtgaaaataggactgagtttgatatccgcttattcattatttttaattatctcaacgattttatggcagacctttagttatcgtttcatcttagtatccttatttttgtcgtatgtgatgctcattaccccgaggattgtttggagaatcttacatgagacgagaaaaaatgtcattcgaaagaaggttagtccactaagaatcttagtagtaggtgctggagatggtgggaatacttttatcaataccgtcgaagatagaaaattgaattttgaaattgtcggtatagttgatcgtgatccaaataaacttggaacatttatccgtaccgctaaagttttaggaaaccgtaatgatattccacgattggtagaggaattagccgttgaccaagtgacgattgccatcccttctttaaacggtaaggagcgagagaagattgttgaaatctgtaacactacaggagtgaccgtcaataatatgccgagcattgaagacattatggcggggaacatgtctgtcagtgcctttcaggaaattgacgtagcagaccttcttggtcgaccagaggttgttttgaatcaggatgaattgaatcagtttttcaaagggaaaacaatccttgtcacaggagcaggtggctctatcggttcagagttatgtcgtcaaattgctaagtttacgcctcaacgattgttgttgcttggacatggggaaaattcaatttacctcattcatcgagagttactggagaaatatcgaggtaagattgagtttgtccctctcatcgcagatattcaagacagagagttgatttttagtataatgtctgagcatcaacctgatgttgtttatcatgctgcagcacataagcatgttcctttgatggaatataatccacatgaagcagtgaagaataatatttttggaacgaagaatgtggctgaggcggctaaaactgcaaaggttgcaaagtttgttatggtttcaacagataaggctgttaatccgccaaatgtcatgggagcgactaagcgtgttgcagaaatgattgttacaggtttaaatgagccaggccagactcaatttgcggcagttcgttttgggaatgttctaggtagtcgtggaagtgttgttccgctattcaaagagcaaataaaaaaaggtggacccgttacggttacagactttaggatgactcgttatttcatgacaatcccagaagcaagtcgtttggttatccaagctggacatttggcaaaaggcggagaaatctttgtcttggatatgggtgagcctgtacaaattttggaattggcaagaaaagttattctgctgagtggtcatactgaggaagaaattggaattgttgaatcaggtattcgtcctggggaaaaactctacgaggaattactatcaacagaagaacgtatcagcgaacagatttatgaaaaaatatttgtaggtcgcgttacaaataaacaatcggacattgtcaattcatttatcaatggattactcaaaaaagatagaaatgaattaaaagatatcttgattgaatttgcaaaacaataataagaaagtaaaagttatttttactttcctagagcctaaataggatttagattctaggaaggttgaaatactttcctgaggtaaaatatgctaggtcataggttattaagagagaaagaaaacagaacgaagggtggtctctatcataagattcagatagagctggctttcaactcaaaccatatagaaggtagtcaactgacgcatgaccagacaaggtatatctatgagaccaatacgattgattttgaagaaaattcaaccataaaggtggatgatattatcgaaacgaccaatcattttacggcttttgattttctcttagatagctttcaagatgatttgaatgaaacttggataaaggagattcatgctatcttgaagagagggacctctgattctcggaagtcatggtttcaagtcggagactataagtcgtacccaaatgaagttggcggacgtaaaacgactttgccagaaaaagtagaatccgatatgcaagaattgctgaacagctatcaccgcttgcctgagacttcctttgaggatattcttgactttcatgttcgatttgaacgcatccatcccttccaagatggtaacgggcgagtaggtcgattgattatgtttaaagaatgtctcaaacatggacatgtcccctttatcatcggagatgacatgaagtatttttactatcgtggcttagccgagtggggagaacagaatggtttcttgctggatacttgtctagcagcacaagatcgatttaagcagtatttggattattttaggattgaggattaggagagggagatgtatccgatttttaaacgagtttttgacattgtgctatcaggagtggctatcttttttttcagcccaattttagtcattattgcgattgcaatcaagctagactctaagggaccagtactatttaagcaaaaaagagttggaaagaataagacatatttcatgatttataaattccgctctatgtatgtagatgctccaagcgatatgccgacccatcttttgaagaatcctacagcgatgattacaaaagtaggagcttttctacgaaagactagtctcgatgaattacctcagctattcaatattttcaaaggagaaatggccattgttggtccacgtccagccctatggaatcaatacgatttgattgaggagcgagataaatatagagcaaatgacattcgtccaggtctgactggttgggctcaaattaatggccgtgatgagttagagattgatgaaaagtcaaaattagacggctactatgttgagaatatggggcttctgcttgatattaagtgttttcttggaacttttattagtgtagcaaagagtgaaggcatcgtcgaaggcggaacggggcagaaagggaagtcatgaaaagagtattgataacaggagcaaactcatatatcgggacatctttcgaaaaatatgttttggaaaaaggtattgattttgaaatagataccttggatttattagagcctaactggaaagactacgatttttcagggtatgattctgtttttcatgttgcagggatagcacatttttctaaagacgaaagtaaaaaagaactatattataaagtaaatactgaactgactgagcatgttgcgaagattgctaagcaagcaggtgttagacagtttatctttatgagcagtataatcgtctatggggatagttcaagttcagagagaattattacaaaagatactgttcctagtccgtctgacttttatggtgatagtaaatggcaggctgaacagagactggaaaagttagtaggcgataattttagagttgtcattctcagaccaccgatgatttatggtaaaggttctaagggaaattatcctaaattatcaaaagtagctcagaaaactccaatttttccagttttttcaaactctagaagtatgctacatattgataacctctgtgagtttattaagcaaattatagacttagagttgagtgggctgttttgtccccaaaattcagaatatgtgaacacttctaagttagttgaagcaatagctgaagtacatggaaagaaaatatattttacaaagacgtttaatccaatcataaagtttttcttccatttagatacagtgaaaaaagtatttggaaatttggtttatgaaaaagagatgagtcgttatacttttgagtatcagataaataattttgaagagacaattagattaacggaagaataattaatgaggtgagtgtttgaaaaaacatatcttagtagtatctcagtacttctacccagaacagtttagaattaatgatatttgtacaaaattagtagaaagagggtacaaggttacggttttgacgggaattcctaactaccctactggctcctactacgatgggtatcactttttctcaaggggagaggttttcaatggggtagagattttaagaatacctttaattcctagaggaaaaagtaagattggactagttctaaattacctcagttttgttttatcaggatatgtttgggcaaaattgactaaagtagatgctgatgcagtatttatttacgaggtctctccgatgacacaggcgctaccagggatatggtatagttttaaacggaacatacctgtactgctttatgtaatggacttatggcccgaaaacgttcaaatcgtaggaggaatccgtagtgtacaggttattaagtatttaaacagaatggtcgattatatttaccataatgtagataaaatcttgacttcttctcaaagttttctgaaaaaaattcaacagaggggaattgatcaggataaattagtattctggcctcaatatgcagaggattactattcaccagtgagagtgcgcatagaaaatgaaatagtttatgggaataatttaaatattacgttcgctggaaatataggagaagcacaaggcttaggaattttaccagaggttgctcttgagttgaagaatagtgatgtgacagttatgttcaatattattggtgaaggtcgttataagagcacattgatacaggaaattgagcgtttaaaagtagaaagttgttttaattttatcggtcaaagaaaaccagaagaaattccttattactttgctaatagcgatgcttcgctgattattcttgctcaaaatgagctatttgatatgactataccggctaagttgcaatcgactatggcatgtggcattccaatgattgcttcattgaatggagaagctgctcagattattaaagaatctcaagctggcttagttagtgaagctggagatgttagagggctcattgataatattttagagttttcaaaactcactcctgacaagaaggaaatttttggaatgaatgcactacactatagtgagacctactttaacagagaaagtttgttggatgagttggaaaaactggtattagaataatgagtaacttgaagagtgaaaaggttatgaaaattttacagataaatacggtaatctcatatggttctacggggattatttgtcaaaatatagcgcgaggtctgattgcgaacgggcacgattgtttgacggtatatggacgtggaactgatgttgaagatattcctacaaagaaaattgggaataagtttgagcaaggacttcattatttacgtagtcattttttagatcaacatgggttaggttctcgtttggcaacacggcagttaatacaaattatcagagattatcaaccagatgtcattcatttgcataatattcacggttattatgtaaactataggattttatttgaagaattgcgtgcattggctattccagttgtttggttattacatgatcaatgggcaatctctggtggtgcggcctatattgagaataatatccggattgtagatggaaagcctataaagatagttagaacacaagaagaaaagaagcagtacccatctgtagcacgaatatcatttagtcgttttgaacaaaatattcgtgataaatatcaggttattactgcaatgactaatttgactcttgtaacaccttcttgttggttgactcgctttgttgaagattcatttcttaaaaaatttcaggtgttgactatctacaatggtatggatacaagacagtttagcgttgatttacctagtaaaacagaaaaaatcaatattttaggagcggccagtgtttgggatgaaagaaaaggactgaaatatttttgtcagctagctgaagaccttggtgataattttcagattacactgataggtgtcgatgatagcacgtcactgccatccaatattataaaagttggtagactaaacagttctcagatggttcactattataaccaagcggatgtttttgtgaatccgacattgggtgacaattttccatctgttaatgtggaggctcaattatgcgggacaccagttatcacctttgatactggtggaagtagcgagagcatatgcagggagacagggaaagccataaaaaaaggagattacaaacttctgttacaaagtttgctttccataaaaaacaaggattatcaaacagccaaaacgactcgaaaacatgctgagaaatttagcacagatgtaatggttaataaatacattgaattatttagaaatcttctataatattaggtgcactaaaccaaggaggggttaccaatgagttatagcaaaggagttcctagaattttatacgttagtggaggaactattgataatggtgggatttctacctatatgagaaattactatcgaaatatagataaaagcaagctacagatagactttttggtgcatggagagaaatcggtccatgatgatgaaatcatctcacaaggtggtatgatttactacgcccctatcaagcgagacaaccctatagaaaacacaaaaatagttaccaaaattttgaaaagcggaaaatattcagtagttcatgcacatatggatggaatgaatggtctatttcttagacaggcaaagaattgcggtataccaattagaatttctcatagtcacaacaccgattttcttactagcaatttattaaagcttttattgcataagtttagtagattattaattggaagatatgcaacagacttgtgggcttgttcagaagaggcaggtagatggctgtacggaaagaatcagtttcaattagtcagaaatgcaattactattaaaaattttgaattttctgcctcaactagacagaggattagaaaagaatttgattttgaaggtaaattcgttatcggtcacataggcaagttgtcctaccaaaaaaatcaatccttcctaattgatatttttgataaatttcaaaaaataaatgaagattctatattggtattggtaggagaaggagaagataaacttttgttacaagaaaaggctaatcggttaggtctttcctctaaagtcttttttttaggagagagggataatgtttcggacttactcaatgcttttgatgtttttgtttttccttctcgttttgaaggattagggattgtggcaatcgaagctcaaacaaatggcttgtactgcatatgttctacaaaagtgcctaaggaagtaaatattacagggaatgtgatttttcataatttggaagaatccgtagatgaatgggtcgattcaatccgtaatatttctacaagagatgtaaattcgaaagaaaaagtgttcaatgctggttacgatattgagtttgctgctagagaattagaaaaaaaatatttagaattagtagaaaaatgaaaaaagtattatttataactaatatcccatcaccatatcgaattgctttctactcattattagggcattacgttgatttaaccgttatttttgaagcgcgtggagcttcaggaattaaatttaattattatgatgaatataagaattttaaggctattttcttgtctgacggagatattaatgaaagaaagataaattttggaatttttaaatatataagaaaaggttattttgattatatatttttgacaaactacggatatgcaacagaacttgctgcctatttaaaatgcattttctgcaaaattgatttcaatttagaagtagatggtagtaaatttagtaacgaaagtaggttgaaatttctatttaagaaatttttattctccaagcctaaaaaaatttttagccctagtcaaactacagattctttttttagaaattatggagtttcttcaaagaaaattgtgcgctacaattttacttcaataacaaagagtcaaatattgaatgacccaatcaacattgaaacgaaaaatgaattgaaaagagaactggggttaaaagaaattccaacaatattatttgtaggtagattaattaagagtaaaagagcggactggctgttagaaacattacagctaatagatagaaatattcaatgcgtaataattgggacaagcatagatagttcgtataaagaattactagaaaaacttgcttccaaagtatccgatgtacattttattgagtttttaaatacagaggagttggagaaatattatagggcaacggatttatttgtatttccagcagttaatgaagtatgggggttggtagttaatgaagcaatggccaaaggtctcccggttatttcaacaattggttgtgttgcagcaacagaattaataaaaaatagtttcaatggttatgttttgtcagaaaatagggattctgtgaacctatcattttttattcaagaagctttagataatctagatactatggggaaaaatagtttgcaatcagtaagagagtattcaatagaaaaaatggtttctcaacatttacaatatatgggagtggattttgaaaatttcagtggcgatgacaacatttaacggaaaagattatcttgtacaacagttagactcaattcgtactcagacagtagcaccacaagaagtggttattgtagacgactgttctacagatggaacgattgagttaattagtgaatatataaaaaattatcaacttgagcattggaaattgatagtaaacagagaaaatgttggatggagaaaaaattttagaaaggctctatcattcacttctggagaaattgtatttttagcggaccaagatgatatatggaataaaactaaggtagaggagatagttttacaatttttaaatgaaaaaaatgcagaagtcatagtaactaattatgatgtattgtacgatggcagaaaagaaagagttcgaataaaaaatattaataaagatgataggacattgaaacgtatcaagtttacatatagaacgatatacgttttgcgaccaggttgtacttttgccatcaaaaggagtattcttgatatgatgagacaatttgatgatccaattcatgctcatgactgtattatttggaatttagcaattataagaaattcattatatatatttaatagaaaactgatttattttagaagacatataaatagtgcttccacaccagtatcggggttgagcagggagaggcgagcgagtgaaataagattagcagaagatttgtcacactttctaatcaaggttgaaaagcatgtaaatagtaattacttttactctcataaacttcaaagaatagtaaattttttaaaaaaacgtcgagaaattattttagatgggaatatcttgcaattacttatgttccaatttaagtcattctatttctatccgacattaaggaatttattgtctgatatcttggtttttttgatgccataaattaaaaatcatgctagtcatctatatgagtgttgctctaggtagcagaaaggtaagattatgaaaaaaataaaagggaaaatgcaacaattgtatgctataaatataaactatggctgctacctagcgttattagaaggaatatcagccgttttaggtcaacggagtagactaggaaaatattttttttatagaaaacacgaagccgctaaacaatatttatgtaaaaaatataaagcaattattgataagtatagagaagaggaatattgtgagagtgtagttgattttaacagaatctggtttttttggtggcaaggagagcaaagtatgccagaagttgttaaattgtgctatcaaagtctacataattactatgaccagtcgaatatttttttgattactcaagaaaatgttcacaactatattgatattcctgattcaatattaaaaaaagttaacaatagaaacttcacactcacgattttttctgattacattagattatctctattgtcaaaatatgggggtatctggttagattctacaattctcttgactaatgctctaaacgaggatgataatgcttatttttttagtataaattatggaaatccagcaatggcttaccatgtgtgtatgggaaaatggatgacatctcttatcggcgtaggtcaaaatacagggatagagttctgtcaggagttgtttgaggtttattttttaacagagaatactcatctgacctaccttctcttggattgtgtattggcattagcttatgaaatatttccaagttttaaagtatcaattgatcgagtaaagatagaaaatacgcaggttggaaggttagatcagttattaaaaggttcttccgatagagaactgtctactattttagaggtgcaatccattcacaaactgtcttataagtctatatataataaaagaaattatgagtatttaaaaagaattgtagagagaagtaatgaataaaatagcgaaaaactatatatataacatggtttaccaacttcttactttggtcataccgttattaatgacaccatatatttcaagggtgttaggagcctcgcagcttggaatttacgattataacaactctgttgtaactctagttgttacgatatcactgtttggaataggacattacggcagtagggagattgcttatgttagggatgatgggccgctcctatcaagaactttttggagcattttattaacacaattttttttagggttagtatgttttggagttttttggggagtagcaatctcatctaattactatatatatactatttcttttggtttttgggttctagggacaattatcgattgcacatggatatatgtaggggtggaggatatggaacatgcagtggtaaaaaatatcattgcaaaattattgttcatactaggaacattattatttgtcaagacacccgatgatttgatactatatatttttttaaatggattatctgttctgttagcgaatatattagcctattctagcttgagaaaatatatttcaaaaccaacttttcatatatctctgatttggagacatatcataggttctttaaaattatttttaccagtagttgcaactcaattgctactctcgattaataaaattattctaggtactctagttacggatatagctgatgtagcatactatgggaatgcggagaagattgttcaaataccattatcgttaatcatggttatgaatacagtaatgatgccaagattagctaatgagtttcgtaataaaaatagagataatattgagagatacatggcgttatcttcaggcttttcaatttttttgtctgttccattaatggtaggcatatttattatttctgactcctttattccatggttcctaggttcagaatttattagttctatatctatagtaaaaatgttgacgcctattattctgttcaatactttgttgggtatttcaggaaatcagtatttggttgctacaaataaaatgaagcctctcttaatctcaaatatcttatctgcagtaactaatatagttttagatttaatcttagttccatattttggtatatatggaatatgtatcgccacaatcgttggactattagtggcactatgtatccagtataatactataaggaaagaaatcagtattttatttatatttcgttatctaattaagtatttatcaatggccttggttatgggattagtcataaaggttttattctttaatgcagaaagcgttatcgctactacagcttttcaaggtttaattggtttagttgtatatgttttaataggtatcgttcttggagatgaaatattatttaaattgtacaatcagtttacaaagagctttgggagaaaatcatgatatcacttttgttttattttatgttttttgttaatttatttcttgtggtaaacaaaaagagttcaaaaacaatagctagtatatcctgggtaattttgttatttgtatacggtggtaatattaggactggtttttcagatttaacttattacagacaacgttactatgaaaatcttaattcgattatttttgatgataaagggtatgtatggttggcagacttcttttctcacaaagatgtatctttccaagtgtttttggcagtcatttttattatttcatcaatctttatttattttatcgctaaaaaactgcaatgtaactataatttgttaatattactcttttcgttgttttattttttctatagtttagaggttattcgtttttttattgcaaatagtatcgctttggttgcatattattggttatttcatcaaaaaaggttattttttattttaggaatgattatagcttattttttccatgcctcaattatttttttgctaccatttgttttcttctattctattaaagatggaaataaaaaaatcagcttactaatagtcgtctcggtatttttaattgttatgaatttactgaatgggaatcaatcaagttatttgataggtttaatcggtccaatttttaatagtgatagtttgaaagagcgtattcaattttatacaggtgcttcaacaagattaggctttttgatatattatctatattttatatttaatatggtgacaatttatcatattcgaaaaattagctatcatattgagaatcttcccttaaataaattaaaggttgttgctggggtctatcagcagaatttatattgtgtaatatttcttccattgataatgttcaatgttacattttttaggtatattatttttactacaactttgaactttgtatgctacgcaatgatttttccttatctaaggaaatcatttagtaaaaataataatcatttagtgataattctttctatcacaggttttacaattttatggtggattatgaaagaaaatgttttaatgttttatgaggcgctacaggtgaatatgtttaattaggagaaaaaaatgtcattattttcaggaaaaacactattaattacaggtggaacaggttctttcgggaatgctgtgttaaatcgctttttggcgacagatattgcagaaattcgtgttttttctcgtgatgaaaaaaaacaagatgatatgcgccatgaatttcaggctaagatgcccgaagttgcacataaaattagtttctatttgggagatgttcgtgatttgcagtcggttaaaaatgccatgcacgatgtggactatgtatttcatgcggccgctttgaagcaggtaccgtcttgtgaatttttccctattgaagcagtgaagacgaatgtcattggaacggagaatgtgctgacagcggctattgacgcaggtgttgaaagtgttatctgtttatcaaccgataaagctgcttatccagtgaatgctatgggaacttctaaagccatgatggaaaaagttgttgtggctaagagtcgaacaactacaaaaacgaaaatctgttgtactcgttatggaaatgtcatgtgttcacgtggttccgttattcctctctggattgaacagattaaatcaggtcagccattgacaatcacagatggtagcatgacacgttttatcatgagcctggaagaagctgtggatttggttctctttgcctttgaaaatggtcaaccaggagatattcttgttcagaaggctcctgcttgtacgattcaaacacaagcagaggcagtgtgtgagttgtttggaggagataaagaagcgattcgtgtcattggagttcgtcatggagaaaaaatgtacgaaactttattaacaaatgaagaatgcgccaatgcaattgatttgggtgatttctatcgtgtgccttgcgacaaccgtaatttgaattacgataagtatttcaatcaaggagatgttgatcgtaatccactgacagaatttaatagcaataatacagagttgttgtctgtagaacagaccaaggaaaaaattgcttccttggcctacattcaagaagaaatggcaaagttaggataagtaagaatgacaaaatatacagaagtaaattggaaaaacaatggcaaactgaaacttttgattattgttggaactcgcccagaaatcattcgcttgtcagaggttattaagaaaacccgtcgttattttgatgtggtcctagtccatactggtcaaaactatgattataacttaaatggcatcttcttccacgatttagatttggaggagccagaggtctatctaaatgctgtaggtagtgatttgggtgagaccatggggaatatcattgcagaaagttataaactgatggttgcgattcaaccagatgcagtgcttgttttgggtgataccaactcttgtctttctgttattggtgctaaacgcctgcacattcctattttccacatggaagccggaaatagaagtaaggatgaatgtctaccggaagagaccaatcgccgtatcgtagatattatttctgatgtcaatatggcttactccgagcatgcccgtcgttatctggctgacaatggcttgcctaaagagagaacctatgtaacaggttcgccgatggctgaggttttaagggtgaatttagaaaaaattgagtcatcggatatccaccagcgtttgggtcttgaaaaagggcgttacattctgttgtctgcgcaccgtgaagaaaatattgataccgacaagaacttcatcagtttgttcactgctgtaaataagatggctgagaagtatgatatgccaattctgtattcttgccatccacgcagtaaaaacaagttggaatcatcaggttttgttttggataaacgtgttatccagcatgagccgttaggcttccatgactataattgtttacagatgaatgcttatgctgtcgtttctgattcaggaactctaccagaagaatctagtttcttcacttcagttgacaagcctttcccagcagtttgtattcggaccagtacggagcggccagaggccttagataaggcagatttcattctttctggaattgatgaaattggtctcctgcaggcggttgatgtggctgtagctatgaatgagcacaaacatttaggcttgccagtacctgattatgttgatgaaaatgtatcagataaggttgtaaaaattattcagtcctatactagcatcgtcaataagatggtttggcgtaaatactaaggagacttcctatgaaaattttagtaacaggcgcaaagggaatgcttggaacagcattggtaaatcacttgaagacgattcaaagtgggaaaaacagaacgcgtcctaatctccatatccaatctatttttgagtatgatatagattcgacgattgaagaattagagcagtattgccacgaggcggactttgtttttaatcttgcgggtgtaaatcgtccggagaataccggagaatttatgcagggtaattttggcttcgccagtcagctattggaacagctcaaaaagtacaatagtaaggctcctatcatgctatcttcttctattcaggcaaccttaattgggcgctatggtgatggggaatacggaaaaagcaagctggcaggagaggaattattctttcagcatggtcaggaacagggagtaaaggtagcagtttatcgtttcccgaatttgatggggcattccagacccaattacaattcggctgtatcaacattttgttgggcgattgccaatgatcaaccttattctgtttcagatcctaaggcggaagtcgaactgctctacattgatgatttagtagatggtatgttggatttgttggagggcaaggaagtttattgtaactatgaggggctaactccagttgaggatattagtggcaaatatgcttggattccaaccactcatcgtgtcaccttgggagaaattattgctctcttggaatccttcaagcaacatccattgaccttgatgatgcccaagattccagccaactcctttgcgaagaaattattttcactctatttgacttacttgccgacagaaaagttcaaatatggtctaaaaatgaatgtggatgatagaggttctttcacggagttgttacacacagctgattgtggtcaggttagtatcaatattagcaagccaggtattaccaagggtcaacattggcacagtagcaagtgggagcaattcatagtagttagtggcagaggtctcattcagcagagaaatattgtcacgggtgaatttgtggaatttgaagtgtctggagataccattgaagctatctatatgattcctggttggactcataatattattaatctttcggatacagaaaatttagtcacggtcatgacctgtaatgagatttttgatccgaatcgaccggataccttttttgaagaagtttgataaagtgacagttttcttgaatatatagtaaaattctcctaattatggaacataactacgattaataatttctatgtggtttttggaatagttcttttccaactctttatcaagaatgatatgttttggtagtccgaaatgttttcagaataagtattgaagagtcagctagaatgtgagggttaattgtattttttgaagttttactataattacaattgttatttttaatggattcattttatatcttagataggcaagggttgtggagatattttaagagtagtactggtaaatggttaataatagttacatatttcgtaacagcccaataacaaggtatctatctactcactctctcctccagtatactgttagagcccgtcccattgactgttccccaatattgccactttgagaagaaaggcaggaatgatattctgatgaaaattcgtctcggaaaagtggaagtcacattctttcactctatcaaccaagagacgtttcaacagttacaaactctccgttgacagcagaagctaactgctcactcaaaaaagtttgttcttcttcaactgtcatataagcgtggcgacgacctcctctagcatctgaagtaagacatgttaaaccatgttcttgatatttcttagtcaatctccaaaccgtatcatgtgagacatcaagcatatccataatggatttgtagggagtttggattgccctgagataaactgcttgaatacgtttgtgataaggtgctaagtttttatcttttagagctgttttgagctctgttatcatttcgttagtaaattccatgttttaatttttgaaattagttaagtattaaatgtaaaaacaatatgaaaaaatacgattatctagttgttggtgcaggtctgttcggagcggtctttgctcatgaggcagctaaaaagggtaaaaaaataaaggttatcgaaaaacgagaccacattgcaggtaacatctatacaaaagaagtagaaggcattcaggtccatgaatatggagctcatattttccatacttctgaaaaagaaatttgggactatgtgaatcagtttgcggagttcaaccgatatactaacacaccagtcgccaactacaagggtgaaatctacaaccttcctttcaacatgaatactttcaataaactgtggggcgtggtgacccctgctgaagctgaagcgaagattgcagagcaacgagctgtattgggaggaaagatacctgagaacttggaagagcaagccatctcactagttggtacagacatctatgaaaaattgatcaagtcctacaccgagaaacaatgggaaaagccgtgtacggagttacctgccttcatcatccgtcgcttgcctgttcgtttgacttatgataataactactttaacgatacttatcaaggtattccaatcggcggttacacgcagattgtagaaaaaatgttggatcatgagaatgtcgatgtggagacaaatgttgatttctttgccaataaggaagactatttagctacctatccaaagattgtctttacaggaatgattgacgagttctttgattaccaacttggtgaattggagtaccgtagccttcgatttgagacagaagtattggatatggaaaactaccaagggaatgcggttgtcaactacacagatagcgagacaccatatactcgaatcatcgaacacaaacacttcgaatttggtacacaaccgaaaaccattattacccgtgagtattcgaagacctggaaacgaggcgatgagccatattatccagtcaacaatgatcgcaataaccatctatacacagcatataagaaattggcagaacaacaagagaatgttatattcggtgggcgtcttggtcattatcgttactacgatatgcaccaggttatcggtgcagccttgcagtgtgtgagaaatgaagttggggaatgattttgagaagtcatcaaggtagtaattgattcttggcagaagttgatactcttcgaaaatcaaaattatccgttgtcaacttgccttgatgaactccagttctatcttcgacttcgtttcctaggctacttttgattttcgttgagtatgaaatgctctcaaaatattaatcaaaaaaaaaaacagaatttctgttttttttttgattattgaattgcggctcattgtcaactgtagtgggtagacgaaaagctaacacctagagaggacgaaattcgttctctcatttttgatgttcaaagcaatatatatcttggttttaaagttcgtaaagttcctaaagccgaacgcttgcctcttgatgtctttgatgagtttattggtcgcttccagcttagcgttggaatatggaagctccatggcgttcgtgatgtacgttttatactttagaaaagttttaaaaacagttttaaaggcaggattgacaagatccaggttgtcctctagaagctcgaagaaatatttcgagttcatctcttggaaatggaagagaaggatctggtagagttcgtaatagaatttcaattcatttgagaaatccaatgtcttctggacaacctctctcggtgttactgtttgcccaaaagtgcgggaatagaagcgatttcgagacagttttcgactatctttttggagaatacgccagtgatttttcatggatcgataaggtagggaacgcgtatcgaaagtcttcataatatcaattctagtcgtcatcatagcacggctcaggtgttggataatgtgaaatctatcaaggacaattttagcttttgggagtgaaacagtctgggaatagactgtttcagcctgagcctagaaattggagagcgaaggggctagccaatttgtagtaggcgctaaacatagcatggttacgacctcgacagtttctctgaccgccctaggatacttgtagaaatagttcttgatggtggtttggcggttgttgtcaagaatggtcacaatcgatctcgtctcaaaattctgagcaataaaggcgagttttcccttgttccgactaaattcatcccagctcaagacttttggtaatttcgtaaaatcatgctcaaattgaaactgagccagtttcctctggacgactgatacggagatatgtaatctcctagcgatggctatattggtcatgttttctgtatggagttgtgtgattttctcccaaataggttgggaaatctgacagtttttcttgactagagttgtctcagctacagtcactttttggcaagatttgcattgaaaccgccgtttcttaagcaggaggagggttggaaaaccctgacaatctaaaatagggatttttgacgacttttgaaaatcgtacttgatacattttccttgacaatgaggacaacgaggactgtcgtaatctagctttgccttgatttctagatgggtctgatgtttcaaaataaagagaattttgatgtttttgtctttgattccaattagttctgtggtatgataaagttgttccatatgagtctttctaatgtgagtgtggttgcttttcattataggtcatatgggactttttgtatatattcaaaaaggctccataatctctatggtggatttacccactacagaaattatagagcctgaattgctgccaacaggtcagctgcttgttgctcgagttttgttagagtttcgtcagaataactccaatacacctgttccccatgcttctggattgatggttgaacctgtaaattcaccagcaatctgagtacggataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaggaacgcttcagcttttttggccatttgatggttaaaagaaccgtcacgtagtgaaccaactaaaaacaatacgtttgccatgatggcctccttttcataaaaacataaatttagtatatcgtatttgtcttttgttggcaatcctaggtctgctggttcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttttttataacgacagtcatgttgccagaagtacttaataatttatcaattaagtcttgaatccgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtactttatatagcatagaggagctgaactgtgggtcccagttcttatattcgttctctgtctgaaggagaatgaaagtttattcacaattcaattacggaaaaaatggaaatatgctttaacttgtagtataataggactactatggaaaaaaagatttttcaacttttggaagtattggcaacgaagaagggacagctgatagttggttcctttatactcctaagtgtcatgactttttcgatattcgttatttgggaccttgcagctaagcctttttctgatgtacagaatcacgctatttctgtagctagagactatgcggatatagaggttgttgatgatgtctctatctacaacgggacagaaacatactttagtgtgcaaggaaagacgagtcagggggaaatgattgcggttatcattcctgaagagacaaatactgtgtacgtttatccaatggcgaatggtatttctaaggaagaagcgcaggtagtcgctacagagaatggtgcgtcagcagctgatagggtgattctaggttttagggatgacaaaccaatttgggaagtcaaatcaggtactgcctactatttagttgaatttgaaacagggaactttatcaaacgggagggcttatgagcaagctatcaaatcgtgtcttagaaatggaagagagtgtaactctggcagcaggtgcgcgtgcaaaagccttgaaggcggaaggacgtgatattttagagctgaccttgggtgagccagacttcgtcacaccgaaaaatattcaagaagcagccattcagtctatcgaaaatggtaaggcgagtttttatacggtagcttcagggcttcctgagttgaaggatgcggtcaatacctactttgagaagttctatggctattctatcgaacgcaatcaagtcgttcttgccacaggtgccaaatttattctctatgctttctttgcggcggtcatcaatcctggtgatgaggtgattattccgacaccttactgggtttcttatgcagatcaaatcaagatgaatgatggggtgcctgtctttgtcactgcaagtgaagagcataatttcaaggtaacggttgaccagctggaagtggctcgtacggataagaccaaggtattcctactcaacagcccgtccaatccgacaggtatgatttacagtcgtgaggaattggaagctattggaaactgggctgtagagcacgatattctcatcttggcagacgatatttacggtcgtttggtctataatggaaatacctttacaccgatttcaagcatttcagaaagcattcgtcagcagactattgttgtcaatggggtggccaaggcctatgccatgacaggttggcgggttggatttgccgttggtaatcctgagattattgcggccatgagtaagattgtcggacaaacgacgtcaaacctaacaaccgctgctcagtatgcagccattgaagcctttacaggtccgcaagatacagtagaaaccatgcgtcaggcctttgaagagcgactcaataccatttatcccttgctggcagaagtaccaggttttgaagtgattaagccagaaggtgccttctatctcttcccaaatgtcaaaaaggctatggaaatgaagggctacacagatgtaactgaatttaccacggccattttggaagaagtaggagtagccttggtgacaggtgctggttttggagctcctgaaaatatccgcctcagctatgcgacagatatggacacgctcaaagaagcagtggctcgactacatacatttatgaaaaaataaaaagaggaaaaataatgtctagaaaattgattaccatcaaccaagtaaaagattatgtcggtcaagaagtgaccattggtgcctgggttgccaacaaatcaggcaagggcaagttagccttcttgcagttgcgtgacggaacagccttcttccaagcagtggctttcaagccgaacttcatcgaaaaattcggtgaagaagctggtactgagaagttcgatgtagcaaaacgtctcagtcaagaaacgtctgtctatgtgacagggattgtcaaggaagacgagcgttctaagtttggttatgagttggatgtgacagaccttgaagtaatcggtgagtcacaagattacccaatcacaccaaaagaacacggtacggacttccttatggataaccgtcacctctggttacgttctcgtaaacaggtcgctatccagcaaatccgtaacgccatcatctatgcgacttatgaattctttgaaaagaatggctttatcaagtttgatagcccaatcttgtctggaaatgcggcagaagattcaacagaattgttcgaaacagactactttggtcaacctgcctacctcagtcaatcaggtcagctttacctggaagccggtgctatggcccttggtcgtgttttcgacttcggtcctgttttccgtgcggaaaaatcaaaaactcgccgtcacttgacggagttctggatgatggatgccgagtattcattcctcagccatgaagagtcacttgacttgcaagaagcttatgtcaaagccttgattcaaggggttatcgaccgtgcgccacaagccttagaaactcttgagcgtgatgtggatgctctcaaacgctacattgcagagccattcaaacgtgtggcttatgatgatgccattacccttcttcaagaacatgaagctgatgaagatacagactacgaacacatcgagcatggtgatgactttggatcacctcatgaaacttggatttcaaactactttggtgtaccaactttcgttgttaactatccagcaagcttcaaggccttctacatgaagccagttccaggtaatccagagcgcgtgctttgtgcggacctcttggctccagaaggctacggtgaaatcatcggtggttctatgcgtgaggacgattacgatgccttggtagctaagatggatgaactcggcatggacaagtcagaatacgaattttaccttgaccttcgtaaatacggttcagtgccacacggtggttttggtatcggtatcgagcgtatggtaaccttcgtcgctggtacaaaacacattcgtgaagccattccattcccgagaatgttgcaccgcttgcatccgtaatacagtcgttcagtttttcttttattacgtcgttaactcgctttgccgtaccttagtacagcctgtagctcgttgcctagtactaaaagtaaactgaaagactgcgaaataaatattcactgacagactacacatgtg

SEQ ID NO: 55 - DNA, 44188 bp, Streptococcus suis
aagggttgtcttttttatgctataattataggtagaaagaggtgtcatatgacctatatccaagtgaaaaatgaaggcaaattctatcaaatgggggaagccctgattattgctaataaagatgtaacctttgacattgagcaaggtgagctggtgattattctaggctcatcaggtgctggtaaatcaaccttgctgaatattctgggcggaatggatcaagcagatgaaggggaagtgctgattgatggggtagatattgccaaattatcaagccatgaattgaccaattaccgaagagatgatgtgggctttgtcttccaattttataacctcgtagccaatttaactgccaaggaaaatgtggaattggctgcggagattgtgaaagatgctcttgatgctgaagaagtcttggaacgggttggtttaggacatcgaaaagataatttcccagctcaattgtcaggaggggagcaacaacgtgtggccattgcgcgtgccgtggcaaagaaacccaaactactgctctgtgatgagccaacaggagccttggattatcagacaggaaaacaggtcttgcaaatccttcaagatatgtctcgtaaagaaggtgcaacagtcatcattgtgacgcacaatgcggcactcgctccaattgcagatcgagtgatccgtatgcgggatgcacgaatccattcaattgaaataaacccgagaccacaggatattagcagtctagagtattaggagagactatgaaaaagaccatctattggaaggacattcgacaatccatgttgtcctccaaagggcgatttttatctatttttagcttgatgatgttgggctcgctggcactgacaggattgaaggtaactgctccaaacatggagcggactgcacaggcctacattgaaaccaatcgaaccatggatttggctgttatgtccgaacttggcatcacccaagacgatgtgaaagagctacaaacgattgacaatgcaaccgttgaggcagggtatttcaaggatgtagtcctggaagaagaccatcaggctgttcgagtgttttcaaaaccagaagaattatcccagtacaccttagtggagggaaattttccaacagctgaaaatcagatagccttatcaccctctctacaagcaagctgtcagattggagatacttttagcatcaaagaacctgacaaaaatgggacagtgctgaaagaaacaaggttcacagttgtaggttttgtagcttcttctgagatttgggacaatgtcaccatgggaatggctagtagtggtacaggacagctgaaaggctatggggtcgtattgccatctgtcttccaatctgatgtctatatgattgcacggatttcctatgatgatttagcaagtctttcctatgccagtcaagcctatactgaaaagctggaggaccataaaaagcaactggaatcgcttgttgctgataatgatgaacagcgtcttgccagtattcaagcagatggacaggaagaaatttcaaaaggtgagcaagaaatagcaaaagctcaggaagaattagcagatgcggagcaggaaatccaagatggaagtgctcaacttgcaacaggtcgggaagaatttgcgcgtggaagggctaaaatcatacaatcggaagcagaacttgcagcgacccagaacactctactcgagacaaaatcacgcttggaagccagcaaacagcaattggatgagtccaagaaaaaattggatcaaacaaaagcctttttagatgcgagttcagcagagctctcacaatccgctcagcaattggaaaaagctcagggagaattagacaaacaaaatgcccaattaaacgaacttgcagcaaccatatcaagcggaagaaacgaatggtatcaagggcagaacgatctcaatacccaaatagcaagtcaagtgaaagaaggagaaagtctatcagattatcctgaattattagcaggtcaggaagccttagatgctgaaaaaattcgtctagaccaattagaagccacatacgaaaaagctcatgaggattacctagcaggatatgacttgcttcaatcaaaaagcgcggaataccaatccggcttgtcacaatatgaaacctggaacgcagaataccaatccggccttgctcagtataatgctggcttgaccgaatacgaaaatggctacgcagcctaccaaaaaggggtcgctgattacgaatggggtgttcaacaactagaatcctctaaccaaaccttaaaccaagaagaactcaggctcaatcaagctgaccaagaattaagtaaggcaaccgaagagtactccactcaaaaagcacaagctgaaaaagaaatcactgcagctcagagcgaaattgaagacgctaagacagagttgagcaagattgaaaaatccagctatcaggtctatacacgctcgaccttacccggcagtgatggctatgtaacctaccaaaatgccacaaaatccatcgcagcagtagggaatgtcttccctgtggtcctctatttagttgctgccttggtgacctttaccacaatggcacgttttgtagatgaagaacgaacccagtctggattgtttaaagccttgggctacaccaataaacaaattatggctaagtttgtcttgtacggactaggcgctggactagcgggggcaattgttggcatcatcttgggaaatacagtcctatctccactcatctcttcaattatcacagagacaacggttatcggtgcatccaccttgtatttctacccactttggaccagtctagccatcggcttaacgctcttatcggctgtgctgcctgcctatctggtcgcgcaacgcgaactctttgaaaagccagctagtctgctcttacccaaaccaccagtatcaggctcaaaaatccttttggaacgctggcgctttgtctggactcgcctgagcttcacacaaaaggtgacagctcgcaacatcttccgctacaaactacggatgctgatgaccatctttggcgtggcggggacagttgcactcctattcggcggcttaggcatccgttcctctatctctggtgtcgtcgaccgacagtttggcgacctgatccattatgatctattggtggtggaaaatagcaaagcttctgaggaagaactagatggtctgtctgattttctacagtctgaccaagttcgacagtccttgcctgtagcatttgaacaattaacagaaaaaattacctcaaatgaccaagaaaaaacagcctccatcagtctttacatcacggatagggcagacttaggaaatcttgtccaattggaaacaaaaaacggaaaggcactcagtctaacaggacgaggcgtcatactgactgaaaaactcgcacaactgtatcatgtcactgttggagatgaagtcaagctgacacttaatgaaaaagaagttgatgtcagagtcgatggcattacggacatgtatgcaggacatttcatttttatgctagatggttattaccagcaggtgacaggtagtcgaaaattggcgaatgcttatctagtagagttgaaaaaggataatgccgaccatgtgcgagacgtagccagtcaactcttagagatgccagcagtgaaaagtttggtacagaatacttcgctcatggccatgctaacgacaatggcagcgtccctacagagcgtcatgaccattttggtggtactgtccatcttactcggactagtaattctctacaatctaactattatcaatatgtcagaacggatccgagaactatccaccattcgcgtacttggatttcaccataaagaagtaaccctctacatttatcgtgaaacgatagttttgtctattatcgggatagtggctgggctgattggaggtttctatctccaccgactcttactatacatgattggatctgatagcattcgcttcaatccagaagttggagtagaagtctatctcattcctatctttgcgattgtagggatcttagcctttcttggttggtacgtcaatcaccaattgaaaaaaattgatatgttagaggcattgaagtctgtagattgatatatgaggaggaagctgaaagcatacaagtttcagtcaactcctcatttttatagctatacagatgacttgaattgtgatagaatgaacaaactaactaatgagttacaattatatgtaaaaaacacgtaaaatgaaaacatattcattttgtgaataataggttattcacttgaatatttgtgagaaatagtgtataaataataagatagactattcatgtgtacgtataatatacgactacaatcataggagttattatggaaacaagtagaacaaggcggcataagaaaaacccatttttaaccatgttaaattggggtctttttgtcctctacggtgtgcttgcaagttacttagcatttacgatctatcgctatcaaatacttaattttcgagggatcaaccatttcttggttggagcgatggtagtattaggaatacttggcgtatttctacttattaaaaggaaggtgaaaatactgacaagtgttttattacttgttggaattgcactttcaggatttggaatctgggggactcaaaatttgattcaactgggttcagcagtaaataagaacgccagttatacaagctatgaaatgcagattgttgtacccgcagaaagtagcatcacagacgttagtcaggtaacgaatctactggcaccaactgatacagacggagacaatattactaagttactggataaactaaagactgaaaagaatgtagacctaactcctaccacaaaagcttcctatttagaagcctatcaagcaatggtagctggagaaggggatgcaatggtcttaaacaatgtcttcttagagatgcttcgttcagaagacccagacattgattctaagattaaagtattatacacaacaacgaatgaaataaaaaatgaggttcctggaaatactgttcaggaaaaaggtcaggccatcaatatctatatcagtggtattgatacctatggaccaatcacttcggtatctcggtcagatgtcaatattatcatgacaatcaaccgtgatacgaaaaaaatcctattaacaactactccacgtgatgcttatgtgaccataccgggagcgggtcaagatcaaaaagataagctcacacacgcaggtatttacggagttgcgacttcagaagcaacgctggagcaattgtatggcatcgatattcactactatgcgcgcttaaacttcacctcattcttaaagatgatagatgtcgtaggtggtgtagatgtagaaaatacgcaagaatttacgagtacacatggcaactattatttcccagttggtcaagtacatctagattctgaacaggccttgggatttgtgagggaacgctattctttagcgaacggtgatagtgatcgaggtaagaatcaagaaaaagtcattgcggccttaattagcaagctgagccaaccggaaaatctggtccattatcaggaaattatccaatctttgtctgattcgatccagactgatatgcaattggaaaccatgatggagttagtgaatcagcagttggaatcaggtggtagctatactgttacttcccaatcagttgatggtacaggaagtacaggtgtattaccttcctatgccatgcctggttatgcgctttatatgttagaactgaatcaagatagtgtggagcaagcaaaggctgctataaatgccgtcatgtcaggtcaatagtcaaaaagaaaataaattaatttatatttggagaaattatgaaaaaccaagaaacaaattcaattgaaatcgatgttttagccttgttaagaacgatttggagaaagaaattcctaattcttcttacggccttgttaacaacaggggtggcttatgcttatagtgcatttttagtgacaccccaatatgacgctacgacgcgactttatgtagtcaatcaaaccactgagggtggggcaagcttgaccaaccaagatttacaagctggtagtttcctggtcaaggactataaggaaatcatcctatcccaagatgttcttcaaaatgttactacaactttaggtgtgtcagatgacattaaagagaaaatcactgtggatattccggtggatacacgtattctttctatttcagttcgagatagcaatccagaacaagcagcgactatcgcaaatgttcttcgtgaagaagcggctaaaaaaatcattgatgtaaccaaggttagtgatgtgacgacacttgaagaggcagcgccggctgaagaaccttcaacaccacaaaccaagagaaatatggcagtaggttttatcgcaggagcctttcttgcaactgctttggtattagttttggaagtactagacgatcgagtgaaacgacctcaagatattgaggacactttaggattgaccttgttgggtattgtacctcaagcgaacaaattgaaataggagatggttatggcaacgttagaattagcaaaaaagaagcgtgaattggttaaaaagacagaagagtattttaatgctatccggactaatattcaattgagcggtacggatttaaaggttatcggtatcacttcagttgagtcaaacgaaggaaaaagtactacagccgcaagtttggccattgcctatgcacgttcaggatataaaacggtactagtggatgcagatatccgtaactctgtcatgtttggatttttcaaaccatctgctaaaattacaggtttgacagattacctggcaggaacgacagatctcagtcaaggcctctgtgatacagatgttccaaacttaacggtcattgagtcaggaaaagtttcaccaaacccaaccgctttattacaaagcaagaattttgaaaatctaatcacgacactccgtcgctactatgactatgttatcgtggattgtcctccacttggactagttatcgacgcagccattatcgctcaaaaatgcgatgcaatggctgtagtagtcgaggcaggacgtgccaaacgatctggtgtacaaaaagtagttgaacaattagaacaaacagatagtcaatttctcggtgtgatattgaacaaatatgatgtggcgactgaaagatacggtacgtatggtaactatggcaactatggtaattatggtaaaaaagcctaaataataggagaagtaagatgattgacattcattcccatattatctttggtgtggatgatggaccaaagacgattcaagaaagtctagaattgataggggaagctcgtaaacagggtgtgcgtattatcgttgcaacttcccatcgtcgaaaaggcatgtttgaaacacctgaaaaagttatcatggctaactttatggagttaaaagctgctgttgcacaagtgtttccagaaacaaccctttgttacggtggagagctatactatacaaaggatatcatcaataaactcgataggaaaaaggtacccactatcaatgggacacataacgtcttgattgagtttagtatgaatactccatggaaggaaatacaagaagctgtcaatgaagtgattctgctagggctgactcctgttatcgctcacattgagcgatatgatgcattggcctttaaaggagagcgagtagcagaactgatagataaaggatgctatactcaagtgaatagtagtcatgttctaaaaccacatctgatcggagatccagcaaaaacgtttaagaaacgggtccagtattttttagaaaatgacttggttcattgtgtagccagtgatatgcacaatatgacgaaacggaagccatatatgcgtgatgcctttgcaatcatagaaaaagagtatggtgttgaccgtgcgaaagctataatgaagaagaatcctttgatgatattgcaaaaataatttttttggtgtcaagcgagttaaaaattgattgatgacatagttatatgatggtaactgagttgaaaccactctttaagtttgccccgtcatctggaaataggagattataaaatgataaatattaatgggtaccgtcgattacgcttggcatttttggagctagttggtgtagctgtagctatctttttaacctatcaattcccaaattcagacttaaaccgcattagcatactattggtattagctctacactttattgctttttatgtgtcacgaatggcaagtgattttgaaagtcgggggcagtttgctgagattgaaaaagtaatggtttatactttgttctttgggttattattgacttttttctcatttatgctagaagatagttttacgatttctagaagaggggttatctatttttcaattatcaattctatctgtatctacggagttaattatattgtaagaaagtataagtatgtttttttggtaacgaccgaacaacaaaaaaataccttagttatcacaacttctgaaagactccatttgatgcagggactctttgaatcagaaaatttaccaatccgttatttagctggaatggtaattatgggagagacagaggaaacgttgtccttgagtgttcctcttgttcattttgatgatgcaatagagtttgctacacgagaggttgtcgatcatgtctttatcaatttaccaagcgaatactatgatataaaaaccattgtatctgagtttgaagtattagggattgatgtgagtgtggatataaattcctttgactttaaagctttgaaaaataaacgaattaagcaagtcggagaccacagtattgttacctttaattcaaattactataaaccaagtcacatttttatcaagcgagtgcttgatatacttggtgcactcgttggtttgttgatttgtggtattgtttcaatcgttcttgttccattgattcggagagatggtggaccagcaatttttgttcagaaacgtgttggaaaaaatggtcggattttcaaattttacaaattccgatccatgtatattgatgctgaggagcggaaaaaagaacttttatcacaaaatcagatgcagggtggtatgttcaaaatggacaatgatccaaggattacacctattggtcattttattcggaagaccagtcttgatgaattaccacaattctttaatgtattgatgggggatatgagtctggtaggaactcgcccgcctactgtggatgaatttgacaagtatactccaagtcagaaacgtcgactcagcttcaagccaggcattacaggcttatggcaagttagtggaagaagtaacataacagactttgatgaagttgttaaacttgatgttgaatacatcgataactggactatttggtcagatataaggattttattaaagacagttgaagttgtaattaagggtgaaggaagtaagtaatggttaatttttttataagaaggcgggaaaatatggaagagaaagaagtaaaaatttgtttcgcagcttcttccggaggccattttgaacaattgatgatgttgaaaccattgatgcagcaatatgatagttttataattacagaaaaaactgaatataatctaaatctaaacaatgtgaaaagttactcgatatcacaaataaataggtcagaaaagtttttgatttttaaaatactccacaatatattagtttcttttaggatctttatttttgagcgcccagatataattattacaacaggggtacttgcaatgattccaatttgtatgattgcaaaaatattcggaaaaaagttaatatatattgaatcatttgcgaaaatcaattctccaacgaggacaggtaagtttttgtataggtttgctgatcgtttttatgtacaatgggagtcgatgttgaaattctatccaaaggcaatttttatgggtggaatctactagaaattataaagtaagggtaagagatgatatttattacattaggttctcagaaatttcaatttgatagactgttggaggaagttgacagactaatcgaaacatcgaaaatagtcgatgaggtttttgctcaaataggaaacagtgattatagaccaattcattacaactttaagggatttttaagtagagatgaatttacttctgtgtcatcaaaagcaaatattattattactcatggtggaacaggagcaattattggggctgtaaaacaaggaaagaaggtaattgctgtaccgcgcttaaaaaaatttggtgagcatatagatgatcatcaagttgaaatcattaaagagtttggaaatagtgatttaatcattgcatgtgaggatgtttcggatttagaactagcacttaaaaatgcaaaaactaaaaagtttaaaaagtatatttcaaataccaataatattattaatgatattagattatatttaaatgaaggcgattgatatgaaagttttaataatttctaatatgtatccggatgataaaaatccttcttatggggttttcgtggaaaaattttgtaatcagctagaaaaaattggaatatcatataatctttctgtgatgaataaagcgaactcaagaatttcaaaaattaaaaaatatatttttttctatattgatgccctcactagaatattattttctaagtatgatttaatatatgtgcattatgcttcacatagcagtataccagttttattagcaaaaccatttattcgttcaaaagtatatgttaatgtacatggaagtgatatttttcctgaaaataaaaagcagttaatgatgcaaaatataactaaatgtatacttttgcaaagtgacaaaataattgtaccaagcgaatatttttttaaatatattgcaaaagaattttctgttgaagaaaaaaaaattgagatttatccttcagcaggaattgatacaaatatttttaagatgaatcttgaggtgaaaaatccacagttccaacagatattggaaaatagagggaataaaaaaatattcggtttttgtgggagaattagcgaaggcaaaggatgggatacctttatacatgcaatagactatttaaaaaaatcagaaaggctcagaggaatatacgttcttgttggagatggtccccaatctgatgagctagagagactgattgaagagaaaaatttgggtaatacagtaatatattttaaacaacttttgccacaaatagaattagcctcttttttttcaacgattgattatttagttttccctactcgaagaaagggggaaagtttaggtttagttgctttagaatcaatggcttgtgggacaccagttatctgtagtaattttgctgcaccaaaacattacattgatgatgggaaaaatggcataaaatttgaagtgaattcaccaagttcacttgccgaagcaatttttcgtgctgaaaatcaagcattgacagactattaccgtatgagtgacagtgctagagaaaccgctagcgaatattttgaagataatatattgccaaagctagaaaaaataataaaacaatagaaaagagaccgtgatttacaattatttatacaaataagttttttaaatcttgtgttaggagatatttatatgaatattttgatactaggggcggctggtttcataggaactaaccttacattagaattgatgaagtcaaaaaacaacaatttaactttagttgataaaaatagagactattttcaattgccaaaattatccgaaattgataatgtttcaataattgaatcatctttagataataatattaattttgatgaaattgtaaaaaatcaagatgttgtataccacctagttagttctgtagttccatcaacgtctaatcagcatatttctcaagatattgaagctaatgttttgtttacttcaaattttcttgaagcatgtgttagaaatagtgtaaaaaaagtaatttttatttcttcaggtggaactgtttacggtaaagttgggaaatgtccattagttgaagagacaaatacggctccaatatcatcatatggagtacaaaaagttatgattgaaaaattactttatttgtataattatatgtatggtttggagtacaaaattgtaagattggcaaatccatatggtccttatcaaaggccaaatggggttttaggagcagtaacaacatttacatataaagctataaaaggtgatgaaataacaatatatggtgatggaagtgttatcagagattacatttatattgacgatgcgataaaagggatcattacaattgcgaacgaatattctgagcataatgttttcaatcttggatctggttatggaaccagcattatggaaatcttagacattattcgagatgaattgaaattaaatttaaatctttcttttaaggaaggtagaagcgttgatgttccaataaatttcttggatatgtcaagatatattgaatcttttggagaaaaaccacaccgagatttaagagaaggtattgttgctacagcaaaatttttatcagaaaattattaagcattttggggagtttaactgtgaatatcgtatatacattcgatgaaggctacgctactattgcaagtgtatcaattttgtcaatgttagaatctaacattgattcatcagaattaaatattattattgttgattgtggtttgagtgaaaaaagtataagtcaaataactagtctgataaacagatttaatcgtagtattaaatttgttaatggaaaaaatatggagaaaaaaattccaattgagttagaactttcatactggtcatttgtgtgttatgtgagacttttttttccagaattattaccacaatatgatagagtcttgcatattgattgtgataccttaattaaaggttctttagaagatgtatataatgtcaacctaaaatcaaatattatatgtgcagcgtgttatgattgtttaccaactgcaaaataccaagcgggtatgagcaaaaacgatgcctatttcagtagtggtataattctgtttgatttaaatgaaatgcgagaagagaatattcagcaaaaatttgtcgactatattgttgatcaaaaaggaaagttgccacatttagatcaagatgtatttaatgtggttttaaaagataggattgctttattacctgcaaattataacctgatgactcaaaatgtagtttttaaagaatcatcttgtgatttttttgtagatgagccttactattcaaaatctgagataaaacaagctttggaaaatccaattatgatacatttagttggctataagtatgttagtaaaccttggtcacaaccatgctataatccatttaataaggactggatacgttattataaaaaattatcattcgatgatggggaattattaaaatacaaaccaaagaaatttggtatttttagagagattgtttgttattgttggaacattggaattcatctaccattactaaaagatattgaattttactttgaaaaaaaacgggtacgtaagaaatgcgctactctgcaaagtgaataaaagtgaggttagtatgatatttacttttttatcaatagctataggaatctatgctttttttgatttcaaaaaggctattcaactgtttactatttatcaaattatctggtatccaacagtgttattaagcataggatcggtaagtttaggtacaaactcagtaattccacttttatttgcaatattatttttctttaaaagacatcaattcaatcctgctaccaaattcccatttacagttccatttgtactaattattctttcatatttgttttcgtgttttactgcattatcaggattctttccagaattctcaaggagtttaatgagaatatttagtgtatacatttatgtatacatactatggaatgttattgaaacagatgaggattttgtatttatttttaaaggtactacatatctaatattcatttcttgtatttatggaattatcgagtatgtaacgggaaataattttgttttagattataagataaatttatctgggaatacaattgaaacttacgaaggatatactttgagaggatatcgcttaacatctctttttgaacacccaattggtgctggaatgacgtttggtttgtattcgatttttactttatctcttttctttaacaaagctagtttgaaatttcaatcaaacttagcaataattacagctattctttgtatcccactaatcattttgactaagatgagaacacctatattatttacaattattgcaagtgcaatcttagttaaattatctagatttgtaagacggaaaacagttttattggttgtggtgttttttatggcgttagtaccaattctagcaatcgtaatatcttcaaactcagctttacttactaacttattttcaacaggaaaatcagctgagataggtggaagtagtttagagatgcgcctcaatcaaatggtggcaattcaggaaattgtcagttcatcacctatttttggtctaggagaaacatttagaaatagcattgttaaaaacggacttacaaatgcagctttaggatttgaaggagtcatttttgaacaatggagtatgcacggagtttttggattagtggcaactgccattttaatttatacttcggtaataaagttaccattaatgtatagaacaaaggaagttgcgatcctgtctcttgcttattgggttgcgtatattgtttcatctttgccttcatttagaatcgtattttattatttatttatattttattttatcaaacaatcagaaatatatagaaatcgccgaagttcgataatttaggagttgattttgaaaaaagcactattgatatgcccacattttatggggtacgatgaaattttagttgaggaattaaaaaaaagatattccgtgacttttttggattctgatttatttctaaaaaaagctagagatgaatataataatttaccaattattattaaattcatctttaaaattattaaaccatttagaaattattatagagaatcgttattagataacgcattagaatccaactttcctattctaattgacaatgaatttgatttaattctttctattaatggtgatggattatcagatgatttttataagattcttttttctcgaaacaaaagttcaaaaaaatttttatacatttgggatgattttgattggttattcaaaagcagtcatataaaatattttgatagagtttcaacgtataatttggaggattcacaaaaatttggtttttcatatttacctgtgtttacaaaaccgatttttttcaatagtatacctcaaaaaaaaatagatatatctatagttgcaactgcgaatcaaaaacgcgtcgattttattagaaaattttatgagaaaaataaagagaaatactctttctatatttacttatatgataaaaatatggactttaattttttcagtaatagtaatccattaagttatgatgagtatcaaaaaatattatcacagtctgtctcaacgttggatattgtaagatttggacaaagaggtcctacaacaagagtttttgattcacttgtaacaaaaaccaaaataataacggcaaataaagaaataattaactatcctataaatagtgctaatgtttttattttagattctgaatttgaaattcctgaagattttataaaaagtgattttgtcgaaggacaagaggcacttatggtggatgattggttaaaaacaatagagaattagataaattgtatagtcggctatctctgtcatgtgatatttagttttaagcaactagctgttgttatttttgggaattttttatctggtttgctctttacagttaatagaaaatattacttgtaagcgaaaataaaattgtttagtactaaaaattgtatagtatcatgttcgactattaaataatatggaggtagattaaatatggactatttgttaagtttagtaattccaacaaatggtatttcagaatgggtttttccagtattggatagtatttatggtcaaaaaattaatgaaaatatttttgaagtcattgttgttaataatggtaataacacagaatttgaaaatttgatgctgaactactctgaaaaacataataatcttatatataagagaacggatgctgatttatttctaaatcaaattgaaggatttaaattagctagagggtcatttattaagtttattaatcatcgaactattttagtgcaaggagcacttcaatatctgatagattttgttaaaaagaatgaatttagacgcccaatcacgtattttttaaataatacttctgaaatacttatacctaatcaaatcacgagtgaatttgattcatttgtttacggtttgggtaagtattcttcttggtctggtggtgtatcatgctggcgagatgatttaaatgaaatattaaagaagtctaatattaacagtaatgatttatttcctcatttaatatttgtatttttttacaaagaagatagagattatttgattgataattcttatcttgttcaagagcttcctactgagtatgttaaaaaaggaaaatatgatattttttatgcatttggtgtccagttcgttgatgcgataaataaattagaaaaactaaatatgattatcttacccacgaaagaacatatattaaatgaaaataaaaaatttctaatatatttatattcgacttttgtcatattgcggaagccgtgttcttatgatctaagctcgtcaagaacatcattaaattattactatgattataaaattattagacgtgcgtcatttgttagactagtcaatcgattaaaatcaagaattcgagggaaattaattggcaaataataactataaaaaaaatactatttataatattataaagtcatgctctactattctgtttccattaataacttttccatatatatcaagagttttagaggcggaaaatattggaaaagttaattttagtaactctattgtaagttattttgctttatttgcatctttaggaattactacttatgctgttagagaggtttcttattatcgaaatgatttggagaagctagaagaaatatcaagtgagattttttcaataaatttgataacgacttttatttcatatgctttgttattggttacactttttttatttccaaatttagaaggatataatgcattaattattattcagagcacatccatctttctaaccacattaggtgcagattggttaaatactgccatggaggattttagatatataactattagaacatttagttttcaattattggctttaattttaatgtttatttttgtacgtactccaaaagactacattatatatgcaatgatttcagtcatttcttcaagtggtggtaacattgctaactatttctatcgaaaaaaatattgtaatatcagatttacaaaaaaattgaatttatctaagcatctatcaccaattattaccttatttggaatgattttggctcagcaagtatttgttaactcagatacaactattataggtattattaaaggtaattatgaagtaggtttatattcaacatcagttaaaatttattcaattgcaagcacgcttttatcttccttattctgggttgttttacccaaactatcagcatcatttagaaaaaaagattttggttcaattaattcaacattgaagtttgttacaggttttacagctacaattggtttcccagtagtgattgggatgtttatgttgagttcggagataatttacttgattgctggttctgaatatttaccagctactagtgccttgcaggtcctatccatttcgttgttattctcgctattttggggtgtggttatgaatatgttgcttcttcctgagggaagagaaaaaatttgcttgctagcttgctctgtcagtgcaatccttaatatcacttttaattttatttttattccacaatttggttttattgcggctgcatacacgacggctttgtctcagttagtaggcttattgatttgtgccccttttgttaataagagagtcattttttatcttcctaggaattttttgtttagtatagctattggatcagtatctgtagttgctgtgataattgtattaagaatggttgttctaaataaagtattgatattttttttatcagttattttttctgttattatatatttcattattcaagtaacattaaaaaactattgggtattagatttttttcaaacatctatattaaaaaatatcaaaaataaaagaaactattaataggagtttaaacagtttctcatcaaaaaagttcaattttactttgatttgaaatgaattgctttgctaaataaaactgattaaggtgttactctttctcgtattatgttaaaaactatataaaaatttggaatagtcagataacattttttaactttattttattatatttattacttaactattcttgattagagctataattgtgtctaatagggacatataacattaattttttatttgccttattaattttgtattgaaaaaatgtgtacaacttaataagtaaatctaaaattcaggtattgaatatttgcaatttgttattttaaaggatatatataatttttgggtatttagttaccggtaaaacaagttgtaataattgtaattgatgattacacaagtatttttctaattacacattcgaaaataaattcataaaaaatgaggtactcttatatgaaaggtattattctagcaggtgggtcaggaactcgtctgtacccacttacacgtgcagcatcaaaacaactgatgccagtttatgataaaccaatgatttattatccattgtcaacacttatgttggcagggattaaagaaatcttgattatttcaacacctcaggatcttccacgtttcaaggatatgttgggagatggttctgaacttggaatttcactttcttatgcagaacaaccaagtccagatggactagcacaggcttttatcataggtgaggaatttatcggtgatgatactgtagctcttatcttaggcgataatatttaccatggtaatggtttgactaagatgttgcaacgtgctgcaagcaaagaaaaaggtgcaactgtttttggttaccaagtaaaagatccagaacgctttggtgttgttgagtttgattcggatatgaatgccatctctatcgaagaaaaacctgaagaaccaaaatcgaactttgcggttacaggtttgtatttctatgataatgatgtagttgaaattgccaaaaatatcaagccatctcctcgtggcgaattggaaatcacagatgtgaacaaggcttacctagatcgcggagatttatcagtcgaacttatgggacgtggttttgcatggttagacacaggtacacatgaaagtctcttggaagctgctcagtacattgagacggtacaacgtttacaaaatgttcaggttgctaacttggaagaaattgcctaccgcatgggctatatcagcaaagaacaagtgtatgagctggcacaaccacttaagaaaaatgaatacggacaatacttgctccgtttgattggagaagcctaatgacagaaaactttttcggtaagacactagccgctcgcccagtagatgctattccaggaatgttggaatttgacattccagttcatggtgataaccgtggctggtttaaggaaaacttccaaaaggaaaaaatgcttccgcttggtttcccagaaagctttttcgcggaaggtaagttgcagaacaacgtttccttctcacgcaagaatgttcttcgtgggctccatgcagagccttgggacaagtacatctcagtagcagacggcggtaaggttttgggaacatgggttgacttgcgtgaaggtgaaacattcggtaacacctaccaaactgttatcgatgcttcaaaaggtatctttgttccgcgcggtgtagccaatggtttccaagtcttgtcagattttgtggcttatagctacttagttaacgactactgggctttggaactcaaaccgaagtatgcctttgtcaattatgctgatcctagcctcgacattaaatgggaaaacctagaagaagcagaagtttcagaggcagatgaaaatcacccactcctcaaggacgttaagcctttgagaaaagaggacctctaatgtttcaagcctctcttcaatgtctttggtcacttagacaaattacttaaagagactctgccaagattgcttacataaaagaaatcttgaggtagtctgataatgcaagggggcgagcaaagcgagccaatagcgatagtttccgccgtagtgaaagcaagattacgttttacgtaatcttgcagggaaattttgaaaccttaggttcaaaatttagccatgaaaccgaaggtttgctggcgtccccactacctaaggaaactagcaaaataagaaaaattcggagaaaaaaatgtctcaatttaaaaatattatcgtaactggcggagctggtttcatcggttccaacttcgtacactatgtttataacaaccatccagatgttcacgtaactgtgttggataaattaacatatgcgggaaacaaggctaacatcgaagccatccttggtgaccgtgttgagctggttgtaggtgatattgctgatgctgaattggtggacaaattagctgctaaggcagatgcgattgttcactatgcggcagaaagccacaacgacaattcgctaaatgatccaagtccatttatccatactaactttatcggtacttacactcttcttgaagcggctcgtaaatacgacatccgtttccaccatgtatctacagatgaggtttatggtgatcttccattgcgcgaagacttaccaggtcatggggaaggtccaggtgagaaattcacatctgaaacaaaatacaacccatcatctccttattcatcaaccaaggctgcatcagacttgattgtcaaagcatgggttcgttcatttggtgttaaagcgacgatttccaactgttcaaacaactacggtccataccaacacatcgagaagtttatcccacgccaaatcaccaatatcttggcaggtatcaagccaaaactttacggtgaaggtaaaaacgtccgtgactggattcataccaacgaccactcgactggtgtttgggcaatcttgacaaaaggccgtatgggtgaaacttacctaattggtgctgacggtgagaagaacaacaaagaagtgcttgaattgatccttgaaaaaatgggtcaaccaaaagatgcttacgaccacgtgactgaccgtgcaggacatgatttgcgctatgctattgacgcaagcaaacttcgtgacgagcttggatggacaccacaatttacagacttctctcaaggtttggaagaaacgatccagtggtatactgacaaccaagaatggtggaaggctgaaaaagaggctgtagaagctaactacgcgaagacacaagaagtgcttaaataagaaatagaaggctgggcttttgtccaagcctttcttaaaataaggagtagacatgatattaattacaggtgcaaatggtcagttgggtacagaattgcgttacttattagatgagcgtggtgttgaatatgtggctgccgacgtagcagaaatggacatcacggatgcggaaaaggttgataccttttttgcggaagtcaaaccaacggttgtataccactgtgctgcttatacagcagttgatatggcagaagatgaaggcaaagaactcaactacaagattaacgtaacaggctctgaaaatgttgccaaggcagctgcaaaatacggtgcaacccttgtctatatctcaacagactatgtcttcaacggtgagttgccggtcggtcaagaatggcaagtagatgaccaaccagatccacaatctgaatacggtcgtaccaagcgtttgggtgaagaagcggttgagaaatttgcagacaagttctatactgttcgtacggcttgggtctttggtaactacggtaaaaactttgtcttcaccatgcaaaatcttgctcaaacacgagacaccttgaccgttgtcaatgaccaacacggtcgtccaacctggacacgtacacttgcggaattcatggtacacttggtggacactaagcaagcatttggctactaccatttgtcaaacgatgcggcagaagatacgacttggtttgactttgcgacagaaatcctcaaggataccaacactaaggtattgccagtggactctagccagttcccagccaaggcaaagcgtcctttcaactcaaccatgagcttggataaggcaaaggcgacaggatttgtcatcccgacatggcaagaagccttggaagagttttataagcaagggaaataatgtatatagtaagcgcccaataacaaagtatattgaaaaaggctccaaagtcctgtcgactctggaacctttttctatttacatgctcttttaatttgtaagcgcccaataacaaagtatattgaaaaaggctccaaagtcctgtcgactctggaacctttttctatttacatgctcttttaattttttccttccatggcaaataagcctctagcacctctttttttgcgagcgtctcctcgttaggtaagtgttctagaagataggtcatatatttttctgcatcaaggccatgtcgtttagcagtttccaaaagactcagaatgacagctgtcgatttggctccctcaaagctctgagagaataaccaattttttctgccaatcactaaggtcttcattgccctctcagccatattgttagacaagactaagtcaccgtccgagagaacggttcggaaagtggtttcgtagttgaggctatactctattgcagtgcccaatttggagcctggcaaaacagattgctcacgacaccagtcaaagaattcgtccatcaagggagccaactctgtctggcgtttatgcagtcgctcctcgctagacaagtcagcccagtcattctctaaggcaaataggcggtcgcaataggctaatcccttggctcctaatgaagtcttgtcggtcttcttaggagtcgcctcaaaaaactttcgtctgacgtgagcccaacagccaaccagctgagccttgtctaattgacgataagcactccacatgtcacaatgaacgtagcccgcatagtccccaagaaatttctccacaactaagccactccgtcgtttgtcgtgatgatagagggtgataccctttttctcatgcttaccagacaagaaggtccagtagaaggttaactcactatcattttctaagaccttgtaggaggtctcatccgcatgaagaataggctgctccaacaatttctcgtgcaacaggtcataaattggttcgaaataatactgactagacttgatgtgccagttggctatttccttccgactgattggcagaccaagcttatgccagtcctcttcctgacggtaattgggcaccttaagattgaacttctgatgaatagtatgggcgataatagaagccgaacccaagctgtgtgccaaaggtgccttaggaacgggagccttgataatcttatcgcttagattcttctgactacatgcctgacacttgtatgcgtgttgaacatggtcaatccgctttaattgtgcgggaataaagaccaactcttgtcgttgaacagtagaaccaatctctttcaactgtccatgacagtctggacaagtgcagtcttcaccctgcagttcgtgatgaacaatctctggagtgaactgactaaaaatagcctgacgaactcccttagctttcttgcgtttataggtaatcgtttctgtttcaactgggtaagtcagcttcttcttcagggagactttcctccccaaacaagctcagctgaccgggttgatacacaaccttctctgatgattttccgtagagtttctgtctcagatactcaacctgttcacgaaggagagtgagttcattagccatcatctctatcgtttttgactgtgtttcaataattttttctagtgatgacataaccaatctccttctttttgtcttattatacacaaagaaaagccatgatttcaatagaaatcacgactttttgaaacatttatttttggactgatagaaaaacctttcatgagccagtccacctgttcggaagtgagggctttaacctcctcttcattgtttggccaggtcaatttcccattttcaaaacgtttatacaataaccaaaatccctgtccatcccagtaaagagctttgaaccggtcttttcgacctccgcagaagagatagacctgacctgaaaagggatccagattgaattgacttttgacaaggtaggcgagagaatcaatcccttgacgcatatctgttttcccgcaaaccaagtagacttgacctaaatcactgagttggattgtcatagaacagtaccttatccaagattgtttccaatatctcttggttgatagagtgaaagaaagtgagttctactttttcgagacgaatcttcatcaggatctcatttctgcttttcttttcagagcgtcgcgatttgggaacagtcaatgggacaatgggttgtgacataaaaaaatcctccagtttttttattacagtatactggaggagtgaatgattggataggtaccttgttatggggcgcttactgtatataaaaagaagaaggggtgttgttgttaatgctaacaaaaaacattcttttttctttgatatagaaattcttgttataaataaaaacaaatggtatactatacttataaaatttttgaggtatatataatgggagaatcacttttttcacaatctacgcttgctaagatcgtattggatggacgaaaacaaaataattggtctcaacaagaactagctgataagactggaatcaatcgtgccatgattagtcgtcttgaacaaggagactatattccatcaatcccgcaacttgaaagcttatctcaagctttggagtttgatcttgcttccttgtttgtgtcaaacagcgagcctacttatgtagcaaaaatcgcaaagacaaatatcgctgttgcaggtacgggttatgttggtttatctaatgctgtactcttggctcaacaccatcatgtagttgcagttgatgtagttcctgaaaaggttgagttaatcaacgatagaaaatctccgattcaagatgattatattgaacaatacttagctgaaaaagagttggatttggtagcaaccttagatgcggaaaaagcatatagagaagctgaaattgtcatcattgctgcaccaacaaactatgacagtgcaaaaaattattttgatacaggacatgttgaaacagtgattgaaactgtcatgaaagtgaatccagatgccttgatggtcattaagtcaacgattcctgtaggttttacgcaagcagctcgtaaaaaattcggtacgaataacatcattttcagtccagagtttcttagagagtcaaaagcattgtatgataatctctatccctcacggattattgtttcatatgagaaagatgacagcgatgctgtgattgctggtgcaaaaaaatttgctgctttgctacaagagggagctttgaagtctgatattgaagtgcttcatatgggatcaacagaagcagaagcagtgaagttatttgcaaatacatatttagctcttcgtgtttcctatttcaatgaattggatacatatgctgagttgaaaggacttgatacggaatccattatccgtggggttggtttggatcctcgtattggagaacattataacaatccttcatttggttacggtggctattgtttgccaaaagatactaaacaattattggctaactatgataatgtacctcaaaatatgatgacagccattgttgactccaataagacacgtaaagactttattgctgatcaggtactgaaaatggcaggctattatgattactctacgcatgatcaattctctcaaacagtcgagaaagaagttgtgattggtatctatcgtcttacgatgaagagtaattcagataattttcgtcaaagttctatccaaggtgtcatgaaacgcttgaaagccaagggtgccaaagtcattatctttgaacctaccttggaaaatggatcaaccttcttcggttcaaaagtcgtaaacaacttgaaacaatttaaagccgaatgtcaagcaatcgtcgcaaaccgatatgacagcgttctagatgatgtacaagaaaaagtctatacacgcgatatctttagacgggattaattttttaagttgtagtcggttgttaataaaaatctaaaagatggttactttgagaaatttttgttgattttcttaatctatctaagaaaaagtaatattactttccgataactctcttcaatctggcataatatagatatcataagaatgaactcattctgaagatgtttgatgagtaatattagagaggattaaaatggaaattcaatttaatacatatagtagtttaggtggagctgtaaaaaaacagttatcaagaggtagatataccatttcagatagaatttgtaaattagaaataatcatcaataacgaagtatcatctattactttggatgataaccattatgtaccgaatgtaaagaattgtagttcgttaccatcagagccgtcagttagattatttgacaattttcttaatcaatttattaataataatggttcaaattgttccttaattgacgcgttgttggagtatcaagaggctaatcttcattacggctaccaaattgaagataaaatattctataaattgtacagtaaagacgagaagttattaaataccggacttcgttctcagtacggggccaaatggatagattattcagctcaactttctaatggtgaaggaataatatttgataaagataatattaatggtttgtgggcaatgaaatctagtgaactaaataatattgtttattgtattgacacatatggtgaccatctttttactttagagctcctgccggatagcttgtaccttcagactaaaaatgagataatcggacataatttcaaagtaatcaggagtatgaaactttcaaaaaatcattggtttcgaaaaatacagttacattttattaatttaagacgtaaacttgatatctaggcataaaaggagatacgaaagttttttagttgttaaatcggagagaatcattatttaaaggcttgaataaaaaatactatcacatattgaaccacttcttgttaaatgaacaatttttagcgacccataacatggtacctatctaatcactcactcctccagtatactgtaataaaaaactggaggattttttatgtcataccccatcgtcccattgcctgttcctaatgtaagcgtctcataacaaggtatctattcaatcattcactcctccagtataccgttataaaaaacaaactggaggattttttatgtcacagcccatcgtcccattgactgttcccaaatcgcgtagctttgaaaagaaaagcagaaacgatattctgatgaagatttgtcatggaaaagtgttgatcacgtttttccaaagtcaagaagactacgcatgaccagaatacctttgtattacctaataaatgttcgacatccacttcgagtcagcataaatacgactcccactttctagattagattggagaaaatagatttcgatgcatctttctgcacccaattggttgcaaaattaaaataaaaatggtacattattaataaagaaaggagttgttcatgccaaggagtcaaaagattgcttcagtagtagaaataaatcaatttttgttggaattcaaaaaatcattaagtatgaatggtattgaatttgttccaagaacttatgatggtattacttctttgggtttagatatagaattagcaaaaatggaactctttgatcttacttttcgtgattacgatagaggtgcaacaaaggattataatggagacggaacggatatctgggagtttggtaaaaatattgatgaagagttagtatacatcaaaattaaattagatagtcttggtaaatgtaaagtactgtcttttaaaaaatctaatggtccatggacattaccatataaggagtagctgtcaattgggaggaaatgatggaaacatatgtaaaaaaagataaagaaatttttttggtgcgggacgaaaatattgaggtggaatctgaattccgatttgattcgttgacacatgagaaagtctttgatgaagaattggatgatagagcaataaaaaaagcatttgaaatatatcgaaaaagaaatgacttgattaccccagaagaaattagaaatattagaaaaatgtatgctctttctcagagagcatttgctattgtaactggtctagggaaatcatcaattattcgttatgaaaatggtgcggttcctactaaaatgaatagttattttttaaaagatataaaatcaaaccctcagagaatggaaaaattatttgagataaataaggatttattggatcaaaaaactcaagaaaaatttttagaaagaatgtctgaattaaaagaaattgattcgcttagtgaaatgaataagttggtatctttctttaatgacgattctccgaacgattataatggttataaattatttgattatatgaaagttattcaggtcatttcatatttttctaaccgtattccgtttttatcgaaaacaaagttaaataaattactgttctacacggatttttcatatttttataaccatgttgtctctctaactggactcacttatatacatgatcattttgggcctgttccaaaaaaatcagaagttttatatgcattattagttgagaacggcatgattgaatggaagccatttccaaatggacaaggtgaatatgtgacgtcatttgcttcgtatgaagaattaactgtcgatgaaattgaggtattgaataaagtattagaaaaatttagagatgataatgcaatcactatcagtgccaagtcacatgaggagaaggcttggacagagacgcaaataaaagaaaaaatatcttatgagtatgcttcagaattaatttataaagtctagtttcagaaaattttcataatcatttttcgactttttgagtggagtgtagaatcgctattgctttatttttttccaacacaattagtctaagttaaggaattacgatatgatgaatagatcttagatctgaattatgaaaaatagtggaatatattcatttattaaacatttttatagcaagatagcgagtagataaataaattttaaaattaaaaagctttgaaaaacgtacaaatgaatgcttttcaaagctttttttaatacaaatttgaatcaaagtgagaacttttattatttttcaatctctgagtcaattgaatcggttacccataggcaacaaatttaacatcaggcatttcaccgatattccacaactgcttaacaatgccacgggctttatttgcaaagtaaggataaccatcttgtttatcataagcagataattcaacaaactcaacctcaccagtctgtgtgtttatttcaatcatacctggaccaggatagttttcaggtgtgtagaagtaaccaacactcttggaattagaaattttttcaagtaaaatcatcattataaatcacctcgatttctttgccacactttaagagcttcataataattaaatttcttgtttattttagtgtgagcttcttcataacttagcccttgtttcatcaagtgaaattctcccaactcatggtgtaacattattaaaccattatcttggatatgttgaccattcatctcagagagtcgtcgccagctctctgccatgtcataactaggttcgaattgttttagtcctccatgtagctcatgttcattaataaatatatggtcaaagattttttcaatatctgaaacgggaaatccactattttgtgcaacacgagtgacttgcattttcctattatgatttctaacttgatcgtaatacatttttgcgtgtttttcgcgctttatgcatactcatcattcttctcgttccatgcaccatagatagatctgttactcctcatatattaattatacaaaattataccgaattataaaacaaatgtatgtgactttcaactaaatgagaagtttcgtggttatttataattttttgaaaatcctacacattcaattttgcacagtacgattttcatttatttgaaatataattatcaagcaaatgtgcaaaaatatatttgggtagtgtatttattttctctgaatcctttttctttctccaataaaaaatataattgtacaacttgacgactttctgaaaggttcaagtgtctagctgtgtgcttttacaagcatttcttgctctgaaatcaaaggtgtataactgcattggattgacagctccatttaccttatccgagataatagggacagatagtccacgcctttccaagttctttgcgccatgtgtaatcggacagacagcgacaaaacctgttgcctgactatacttgtgactagagacaacaagcgctggcctgcgtttctggatttcttttccaagcgaggggtcaaagtcgaaccagatgatgtcttgtttttgtggtgtgtccttatccttcattgtcaagcaagagtactccttcaaagtgattgtccatgatgaagggttcaatattgtcaaatggattaggaattttaggtgcaagtacaatgacatcatctacccctttgtaatcgatgaactctttcccctccttaactttcaattcttttggaatggtaataactagagaatttccaactttccgagttttaacagtgtgcatgtgtatccctccttgaaatacactgagtatacactaaatgaaataggaaggtaaattgaaagaaatggagcatgtcgaatgaataacgggtacaaagattgtatatacaaggtattcgaagaatgataaaattggaacaatttgattatttaaggaccttgagtaacgatctcttaaagaaagttctggctttttgactgctgtctgaggtatggtataatcttcatatgaaaaagattagtgatttaggtttaacaggtcgaaagctggttggtgaggggctgattctagtcatcataggtattggctttctgattgctggttggcaatttccaggattgattcttcgctttgttcatgctggtttattctttctagccctatatgaattaagtatgattttcttcagaaagaagaaatcaagcgaaagtgtaatagcactactgggaaaagcggtattatttgggatattggccagtcttgatttagctgtccagattcccttgtattttgcggcgattttcattggtatataccagctgtttacagcggtgataaattttatcacattttacttgtataaaaaagatggtgtgcagccgagaattcgttatttaatggatggaatttggttgtccattctaggcgtggcatctttgtttgtttctgggactcaactagttgttcagacatttatcattgggagctaccttgtgttatatggattgaccaatctacgtgacggattcatttttgaagagtcaattgaacaacagagtctcaaacgtcatgtgagactgactttgccgttatttattgctgctctcgttcctcgaatgactctacaaagagtcaacgactttctagcagacaataaagatcagacagcacaggcagcctataatcgtcataaagacatttctgttactccatctttagaagtatttgtacatgttggtgaagaaggttttggggctgtagggcacgttgatttgagttacaaagggcgggtctatggctacggttcttatgatgtcttgtcggaacgtctgggtggggcgattggtgatggtgttttatttaaagctgagcgccaagcctatattgacttttgtacccatgaggggatgaccatgcttggttaccagatggtattgagtcctgaacaagaagcagctattgaagaacggttggatgagattgacaagctgttggtgccttggaatccaagttctgaaaaagtatcaaaaactgcagatggacaagcgattgaaatgtacgcctatcgcatcaatgaagagatcggtgctgagttatttaaatttagaaaatcaaaattcaaaacctattttgtcttatccaccaactgtgtcctcttggcagactcagtcattggacaagcaggcacggacatccttggcattcgaggatttatcgcccctggtacctatcaaacttatctggatcaagaatatgaaaaaccacatagtatggttgttgcaaagaacatttattatcgcaaagaaaaatcctagcttttgctagttttttctaattaatcaggtaacctcatacagcaaaatccctgatttcaagccaagtataaagacagaaaaaagcatacactacaaaatttttcagacagtaaagctctctaaacgttgatattacagcgtttatggagctttttctgttttttaactgataaactttgaaatatcctagtattttctagttttttctatttgattaggcgtccacccatctaaaaatagcaatatatttacgcaccaaaattggtgcgaaaatattttttgtgttataatgaaaatatatacgaggaggtctatatctatgattggagacaatataaaatcactacgccgaacacatgatttaacacaaccagaatttgcgaaaatggttggtatttcacgcaatagcttaagtcgttatgaaaatggaaccagcaccatttcaacagaactcatcgaccgcatttgtcaaaaatttaacgtctcttatgtcgatattgtaggggaggataagatgttaacacctgttgaagattaccaactgactttaaaaattgaagtgatcaaagaacgtggagcagccatattatcacagctttatagatatcaggatagtcaagatattgcttttgatgatgaatccaatccttggattttgatgagtgatgatttggctgaattgatccatacgaaaatataccttgtcgatactttcgatgaaatcgagcgttataatggctacttagacggtatcgagcggatgttagacattgtgcatcatcgggtggtagcttaatgagattggaagaattcagtgaaactgagtttcgtaaggcattgcagcgaaccattcggaccttaacccgaggaaagacgattccagatcaaccgaaagctatcttacttggtggacaaagcggagcaggtaagacgactattcatcgtatcaagcaaaaagaatttcaaggtaacatcattatcattgatggtgatagctatcgtccccaacatccaaattacctagccctgcaagaaaagtatggcaaggatagcgtggactataccaaggaatttgcaggaaaaatggtagagcatctagtcgatgaactcagcatgcaaggctatcatctgttaattgaaggaactttgagaacgacggaagtcccaagaaaaacagctcaattattaaaatcaaaaggataccaaatttctatagctgtgataggtacaaaaccagagctttcttatctcagcaccttgattcgttacgaagagctttatgccatcgatcccaatcaggccagagcaacaccaaaagaacaccacgatggaattgtagagaacatagttgataacctaagggaattagaaagagagcatttctttgattgtattcagatttatcaaagagatagaacttgtatctatgattctgaaactgatgaaggccccgcagctgaagtgctacaagagtgtctctttggaaaatggagtaaagttgaggaagagatgatgaaggtggggatggaacagttaagggagttgagggagaagtaaaagaggatgagcaataattattccatttctatggcatacactacacaatttttcactgaataaagctctctaaaccttgatatgacagcgtttatggagattttcctattttttaactgataaactttgaaaatcccagtttttgctaggttattctaattgatcaggcaactacataccataaaatctctgatttcaagctatagatcacgtaatatcaacatttctaagttaagtttttaatctgtagtgctttactgagataatcatttttttatttttcttgttatcgcaaggaaataatcaaattgaatttccatttttaagattaataattaatttatgtaaaattactggattatttgatgttattcttgataagattgcgcaagaaggagttgattggctctactataaaaaatacacagagcaaataacaattatacaaaagcatatgaattcaagtgaatcaattgttgtatttctatatttctgtatttatatatttacgaaaacccgtatttgatgattctttagtagtttattgtaaactcgataaacaaattattgtatgcatagataactctgtgtattgcttgacgaatctataagaaactgatataatcactccattaaatttaaaaaaggtgtgaaaatggaaaaatatattcgtaatgcaaaaaatatcaaacaaacgcagtttctaaaggttttccttatttttggtatactgggaatatttttgtacaattccccactttattggttgtttctcattttatttttcttattttatttagtattcaatcttatcgctttttttgtatacttcaaggaattatggaaaacggagccctttacgtgcgttattgtgatattgcttttcagctttgttttaattccattgccattcattagtcttgaaaacgatcatcaattttctgaaactgtaaaatccttttacgcacttgcagttggtattggagtcaactatgtcattgatagtgtttttaaattagtcgaagctgatacaatagaccaagaacagattcgcgtgaaaaagaaagcggctattacaaagattttctttaattctttatatatttcagaatatgtgacatttcttttagtagaacaacgacaaatttttcttgcaatttttaataatctaagatggtcttggttgaataatctcctccattatttggttgaagaaacaagctctccctgggcactaattgtactgacaatgggtatctttgtctgtttgataggtcttactttattcttgaaagatacaattactaatgaaattattaaagaatcagagagagatgtttccgctagaggaaacaagatgctaacagtcgaagatgtctcacagcatcgtgatacaaatgaaaagttagatcaggaaatccagtcggatttaggtgatatagcggaaaaatgacactactagttagaccatcaagattctacagattagtagtactttctatccaaagtttgttggattcatcaccaatataaagtcctcttcactatgggtttttaggactttcatgctataatagttctatggataaaaacaaattattattaattgatggctcttctgtagcctttcgtgctttctttgcactctatcatcaaatcgatcgctttaagagtccgactggtcttcataccaacgccatatatggtttcaacctgatgttggatcacatgatgaagcggattgagccgactcacattttggtggcatttgatgcagggaagacaactttccgaacagagatgtttgcggactataaggcaggtcgtgccaaaactccagatgagttccgtgagcaatttccctttatccgtcagatgctggatgccatggggattaagcactatgagctgagccagtacgaagccgacgatattatcggtactttggataaaatggcagagcggacagacattcctttcgatgtaaccattgtcagcggtgataaagacttgattcagctgacggatgaaaacaccgttgtggaaatttccaagaaaggggttgccgagttcgaagaatttactcctgcctacctcatggaaaaaatgggcatcacgccgacacagtttattgacctcaaagccctcatgggagataagtctgataacattcctggtgtgacgaaaatcggtgaaaagacaggtctgaagcttctaacggagtttggttctttggaaggaatttatgaacatatcgatagcatgaaggcttctaaaatgaaagaaaacctgattgcagataaggaacaggcctttctttctcgaacccttgcgaccatcgatacgcaggcaccgattgaaattggtttggatgacattgtttaccaaggtccacggattgaggagttgggccagttttatgatgatatgggcttcaaacagttacgggcccagctaggcacggcgaacacgcaagaggaagaagtactggattttcaaatcgtatctgaagtcagctctgctatgttcaaaaaagaccaattcttttactttgaaatcttgggggaaaattatcaccgagaagaggtagttggtctggcttggggggacaagcatggaatctatgttggtggtcctgagctcttggatagtccagccttgaaggattttctggaacaccagcctatcaaaacctatgatttcaagcgtggtaaggttttgctttctcgtaaagggattgatttgtcacctgcaacctttgatagccgactcgccaagtatttgctttcgacagttgacgacaatgcgctgacaaccattgcccatctctatggacagaccagcttgattcctgatgaggccatttacggcaaaggtgcgaagttggccctgcctgagcgtgatgtattcttcccacatttggcccgcaaggtgcaggtcttgatggagacagaagcaccgatgttggccaagttagaggaaaaccagcagtccgatcttctctttgagatggagttgccgcttgctaatgtcttagccaagatggaaattgctggaatcaaggtaaaagttgagaccttaaaagccatgcaggctgaaaatgaagtcttgattgagcagttgaccaaggaaatctatgagttggctggtcaagaatttaatatcaattcgcctaagcagcttgggactattctctttgaggatatgggcttgcccttggaatatacaaagaaaaccaagacaggctattctacagcagtggatgtcttggaacggttggcaccaatcgccccagttgtttcaaaaattttggactaccgtcagattaccaagcttcagtctacctatgttatcggcttacaggatgccattttagaagatggtaagatccatacccgatatgtgcaggatttgacgcagacaggtcgtctttcatcgacggatcccaacctgcaaaatattcctgttcgtctggaacaaggtcgtttgattcgtaaggcttttgttccttcgcttgaaaatagtgtcctcttggcatcggactattcacagattgaattgcgtgtattggcccatatttcccaagaccaacacttgattgaagccttccaacagggtgctgacattcatacgtcaacagccatgcgtgtttttgggattgaaaatgcagaggatgtgacgccaaatgaccgccggaatgccaaggccgtcaactttggtgtggtctatggaatttctgatttcggtctttccaataacttggggattacacgtaaggaagcaaaagcctatatcgatacctattttgaacgtttccctggtatcaaaaactacatggaaaccattgtgcgagaagcacgtgataagggctacgtagaaacgctctacaagcgtcgtcgggaattgccagatatcaactctcggaatttcaatgtccgaaatttcgcggagcggacggctatcaactcaccgattcagggttcggccgctgacattctcaaagtagccatgatcaatcttgataaggcactgacagaagctggcctttcaacccgtatgctcttgcaggtacacgatgagattgtcttagaggtgcctatggcagaactggaaacagtaaaagctatggttaaggagaccatggagtcggccattcagttgtcagtcccattgattgcggatgaaaatgaaggtgagacttggtacgaagccaaataagcacaagggagaaaaatgatgaagaaattacttgttctggcaagtgtatttagtttatttttagtggggtgtggaaaaaacgaacagtcaagttcaaatcaacaaacgagtccatccggagaagagttttcaacaaccctgcctatcttacaggaaaagacagacacaagcaatgaaacattgactgttttggccaacgcagaaactgttgtcgtgaatccgaatccaccggcagatgaaactcaaaaaggtcacaaaattcatgcggccaataatggagttgctgaaaaggatgagaatggaaatattaaggagtattatcgttactacgatattccaagtaattggacgcttaatacggaaaatacagaggatgaaacttacgttgctgtctatgatgtaaaagatggatctagcaactttatggtccaactttataatatcaatgcctttaataaatctcctctggaagaagggcataatatgactcccgaagaattgcctgctcgaatgaaagaaaccaatcatgagttttcagaacagacaatcgttcaaattgcaggtcaggaatggcaggtcggacgtcagattatgaaggatcagaaattggctcgactaaccttttacagaatggaatctactggttcttatgatgattctgtcgtagttggagcgatttattattcccttgaccctggacttgataaggataggaccttgttgaaaaaggcaattggccagttgaaggatgtcgtttatcaaatttctaaaaagtaagtttcctatcaactggttttgatgattttagtaaaaggagaaacatatgacctatgcatttcagaatcctagtcaagagattattttcggatatctcaaggaagctaaaaccattgcggttgttggcttatccaatcgggaagaaacagcagcctatcgggtttcaagtattatgcaggatgcagggtatcggattattccagtaaacccacggtctgctggagaaatgattcttggagagactgtttatgcaagtctcaaagatatccctctctccatcgatattgttaatgtctttagacggagtgaatttctcccagacgttgctcgtgaatttattgaaacagatactcgaattttctgggctcaactcggactggaaaatcaagaagctgaggaaatccttcgtcaggcaggtcgagaccagattgtcatgaaccgatgcattaaaattgaataccaaaagatgattggagagtaaattcatcatcgaatatcaatttaggtgaaaataaataaaagctatagaatcttggcaaatctctttttaggggagttggcaaaatctatagctttttgattgcaaaaaaccgagctgcttggctcggttggtggtttatgattgtcagatgcttttagttgattgctgcaagaagggcatctgcttgttttgtaagttgtgcttcatcaacaggtgcaccatttgttgcaagagttacttcatcaacaaagttagtgcgaataaatggtagcaatgaacggtattgagctgcagcatcttcttgatgagcaaatgaagtaactgaaacagttgttactttttcgttgattgctgaaacaccacgtgtatcggatagatcaagtgcgcggcttaaccagtcaagaacatttttcactgtacctgggatagcagcgttgtaaactggtgagaaaatccagatagcatcagcagccaaaactgcttcacgagcttctttaacagctgcaggtgcgtcagcttcaaggtcttgtgaaaatagaggaatatctttccaatcaagatatgaaacgcttgctttaccttccaacactttttcagcagtttttgccaactcagcagagaaagctccttcgcgaagagaaccaactaaaaatagaacatttgccatacagttaatagctccttaaaataatttgataggtttagtataactcttttatcactagttagcaatagtaagtttagttagtttttaaattttttcaaaatctcagctagctgatcttgctcttcttgactgaggacggaaaagagttcccctacatgtgcataatgatcaggtaggattttttcaatagtttctcggccgtaaggtgttagtccaatacgaaaagccctgcgatccttgcaatcagttgttttagatatgtagccatcgcgaatcatatttttgatgacaaccgtcatgtttccagaagtactcaatagcttatcaatcaggtcttggattctcagttcacctttgttatagagtgcctccaatactccaaattgtgcaactgttaatccatattttctgatagtttccatttctttctttgagatggtgtttgctgctcttcgaaaaacgacaaggctgtgtaaggcatgtttgttttcgtttaatgatttttctacgctattcatacgaatattttagcaatatttaccttgattggcaagtgattttaaacaaaattccaacaaattagtaggtaatttctgtaaaaataggctaatttttcaattagatttccatttttattttttagaaaaaatagcaaactgtgtggatttgtagtataatagggatactatggaaaaaaaattcaacagacttatagcatttgcgagtagtcgtataggtcaatttcttattggtttttttgttctcctatcttgcgttgtcttttcggtgttctatgtttgggataggtcattaagtccttttgagcaagcacgagtagaagctcaacaaattgcacagcaatatgcggatgtgaatcaggtggatgactttgcaatctataatggtacggaaacttattatagcatgaaaggtaaagataagaacggagatgaggtatatgtattgataccaagttcttcgaccactatttacgtctatccagttgggtcagggattacaaaggaagaagcgcaagcaattgctcaggaaaatggtgcaaaaacggctgatcgaactattctaggctatagggatggtaaaccgatttgggaagtcaaatcggggacagcctattatttggtggattttgaaacaggtgactttgtcaagatggagggattatgagcaagttatcaagacgtgtcttagagatggaagaaagtgtgaccttggctgctggtgcgcgtgcgaaagcactcaaggctgagggtcgcgatattttagaattaacgctgggggaaccagattttgttactcctaaaaatattcaagaagcagctattcaagccatcgaaaatggtaaggctagtttttatacagtagcttctggtcttccagagttgaaggatgcggtaaatacttactttgagaggttctatggctactctattcaacgcaatcaagtagtagtgggtacgggtgccaagtttattctctatgctttctttgcggcggtcatcaatccaggtgacgaggttctcattccaacaccttactgggtttcatatgcagatcaaatcaagatgaatgaaggagtgccagtctttgtgactgcgacggaagagcatcatttcaaggttacagttgatcagttagaagcagctcggactgacaagaccaaggtcctcttgctcaatagtccatccaatcctacgggtatgatttatagtcgtgaagaattggaagctattggtaattgggctgtagaacatgatttgttgatcttggcggatgatatttacggtcgtttggtatacaacggtaatacctttacaccgatttctagtatttcagagagcattcgtcaacagaccattgttatcaatggtgttgcaaaagcctatgccatgactggttggcgggttggttatgcagtaggtaatccagaaattatcgcagccatgggtaaaattatcggtcaaacgacttcaaacctgaccaccgttgcccaatatgcggccattgaagcctttactggcccccaagatacggtagaaaccatgcgtcaggcttttgaagaacgactcaataccatctatcctttgcttgcggaggtgccaggatttgaagtggtcaaacctgaaggagccttttatctcttcccaaatgtgaaaaaagccatggaaatgaaaggttttacagatgtgaccgagtttacgactgccattttggaagaagtcggtgtggctttggtaactggtgcaggttttggtgctcctgataatattcgtctcagctatgcgacagatatggacacgcttaaggaagcggtcgctcgtttacatacatttatgaaaaaataaaaagaggaaatagaatgtctagaaaattgattacgattaaccaagtgaaagattacgtgggtcaggaagtgaccatcggtgcctgggttgccaacaagtcaggtaaagggaaattggccttcttgcaattacgtgatggaacagctttcttccaagctgttgcgttcaagccaaacttcatcgaaaaattcggtgaagaagctggtactgagaagtttgatgtggcaaaacggttgagccaagaaacttctgtatatgtgactgggattgtgaaggaagacgaacgttctaagtttggttatgagttggatgtgacagatcttgaagtaatcggtgagtcacaagattatccaattacgcctaaagaacatggtacagacttccttatggataaccgtcacctttggttgcgttctcgtaaacaagtagccatccaacaaattcgtaatgctatcatttatgcaacctatgaattctttgaaaaaaatggctttatcaaatttgatagcccaatcttgtcaggaaatgcggcagaagattcaacagaattgtttgaaacagactattttggccaacctgcctacttgagccaatcaggtcaactttaccttgaagctggtgctatggctcttggtcgtgtcttcgactttggtcctgttttccgtgcggaaaaatcaaaaacccgtcgtcacttgacagaattttggatgatggatgcggaatactcattcctcagccatgatgagtctcttgacttgcaagaagcttatgttaaagctttgattcagggcgttattgaccgagctcctcaagccttggagactcttgagcgtgatgtggatgctttgaaacgctacatcgctgagcctttcaaacgtgtagcttatgatgatgccattactcttctgcaagagcatgaagcggatgaagatacagactacgaacacatcgaacatggggatgactttggttcacctcatgaaacatggatttcaaattactttggtgtaccaacctttgttgtgaactatccagctagttttaaagctttctatatgaaaccagtgcctggcaacccagaacgtgtgctctgtgcagacttgcttgctccagaaggctacggtgaaatcatcggtggttctatgcgtgaggacaattacgatgccttggtagcgaaaatggatgaacttggtatggacaagtctgaatatgacttctaccttgatcttcgtaaatacggttctgtaccacacggtggtttcggtattggtatcgaacgcatggtaactttcgtagcaggtacaaaacatatccgtgaagcgattccgttcccgagaatgttgcaccgcttgcatccgtaa

SEQ ID NO: 56 - DNA, 26905 bp, Streptococcus suis
attacaggtgggctatctggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagtgagagagctttttgcatgataagattggtatcgtagtcgattagactcttatgtttgatgaaggtatcacgtagctggttaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataggttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagatagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagccggtgctggatgccataagtcaatttgatgtaaaaaagatggctgctttttataaattgaatgaagaaaaggctgagttagaagctgaccgttggtatcgaatcaggacaggtcaagcaaaaacttatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcaccgcttagattttcaagggagcttaaagatagacaatcagtctttgaaacagtactggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagttatgaacaagattgaacaagataacgtttttcatcactaaatatggctatgtggctagtaaaatattgttttttgtgatacaataggtgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcacttgtcatcacttctgtcggaatctatggaatgcaagaagttgtaaaattttcaacacgactaaattcaaattcggcattttcagaatatgaaatgagcatcctcgtcccagtaaatagtgagattacagatgttcgacaggtcactaatgtacttgctccggctgaatacgatcaagacaacatcactgctttattaaatgatatttccaaaatggagtctactcaattaactacaagtccgacgacctcttatctaacagcctaccaagctatgctaaatggcgagagtcaagcgatggtcttcaacggagtttttaccaatattttagaaaatgaagatccagacttttctccaaaagtgaaaaaaatatatagtttcaaagtgactcagactgttgaaacagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacattgctattgcagatggtgggcaaaatcaatacgataaactaacacatgctgggatttatggtgttaacgcctcagtgcacaccttagaaaatctttatggtattgacattagtaactatatccgactcaactttacttccttcttacagttgattgatttggttggtggtattgatgttgaaaatacccaagaatttacaagcggagggtataatttccctgttgggacagtgcatctagatgcagagcaagcgctaatctttgttcgtgagcggtattcgttggctaatggtgataatgatcgcggtcaaaaccaagaaaaagtcattgcagccctcataaaaaaattgaggtcaccagataatctagcgaattatcaagctattctaactggtttggaaggatctatccaaacagatttgagcttagaaacgattatgggcttggtaaatacccaattagaatcaggaacacaatttacagtagagtcacaagcagtgacaggaacaggacgctcagatttatcttcttatgcgatacctggttcacaactttatatgatggaaattaaccaagatagtctggagcaagcaaaggcagcgattcagtcagtattggatggaaattaaaaaataggagaaaacatgaataatcaagaatcaaatacaatcgaaattgatgtattatcattattgaaaacaatctggagaaaaaaaatcttcattctagtaactgcggtattaggagcagggctggcatttgtttatagcagttttttggtaactccacaatatgactccactacccgtatctatgtagtgagtcaaaatgttgaagctggtgcgggcttgactaaccaagagttacaagcaggtacctatttggtaaaagactataaggaaattatcctatcacaagatgtattgacgcaggtagctacagagttgaacttgaacgagaacttaaaagaaaaggtttcagtttctatccctgtcgatactcgtatcgtttctatctccgtgcgtgatgcggatccaaatgaagcggcacgtatcgcaaatagtcttcgtacctttgcggcgcaaaagattgttgaggtcactaaggtaagcgatgtgacaacacttgaagaagcagtcccagcggaggaaccaaccactccaaatataaaacgaaatatcatacttggcttattagctggtggtatcttggcaacaggtcttgtactggttatggaggttttggatgaccgtgtcaaacgccctcaggatattgaagaggtaatgggcttgaccttgcttggtgtagtaccagattcgaagaaattgaaataggagaacaatatggcaacgttagaaattgcacgtaagaaaaaagaattggtaaataagactgaagaatatttcaatgccatccgtaccaatattcagcttagcggagcggatattaaggttgtaggcattacctctgttcaatcgaatgaaggtaagagtacaactgcggctagtctcgctcttgcctatgctcgttcaggttataagaccgttttggtggatgcagatatccgaaattcagtcgtgtctggtttcttcaagccaatgacaaagattacaggcttgacggattacctagcagggacaacagacttgtctcagggattatgcgatactgatattccaaacttgaccgccattgagtcaggaaaggtttcacctaaccctactgcccttttacaaagtaagaattttgaaaatttacttgcgactcttcgtcgctattatgattgtgttatcgttgactgtccaccattaggactggtaattgatgcagctatcattgcacagaaatgtgatgcgatggtgctggtagcagaagcaggcaatgttaagcgctcatctttgaaaaaagtaaaagagcagttggatcaaacaggcacaccgttcttaggcgttatcttgaacaaatatgatattgccaccgagaagtatggtgaatacggaaactacggaaattacggcaaaaaagcttaatttctcagataatataagtttgataagtaggtattagtatgattgatattcattcgcatatcatatttggtgtagatgacggccccaaaactattgaagaaagtctgagtttgataggcgaagcttatcgtcaaggtgttcgctatatcgtggcgacatctcatagacgaaaagggatgtttgaaacaccagaaaaagtcatcatggctaactttcttcaacttaaggaagcagtagcagaagtttatcctgaaatacgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgatgctacttgggctaactcccgtacttgctcatatagaacgatatgataccctagcgtttcatgcagagagagtagaagagttaattgacaagggatgctatactcaggtaaatagtaaccatgtgctgaagcccgctttaattggtgatcgagcaaaagaatttaaaaaacgtactcggtactttttagagcaggatttagtacattgtgttgctagtgatatgcataatttatctagtagacctccgtttatgagggaggcttataagttaataacagaggaatttggcaaagataaagcgaaagcgttgctgaaaaagaatcctcttatgctattaaaaaaccaggcgatttaaactggttactctagattgtggagagaaaaatggatttagaaactgttaccgataaacttttagagcgcaacattaaacgattgatactcatgtgcatggatacgtgtcttattatagtttccatgattttgagcaggctgtttttggatgttattattgacattccagatgaacgctttattcttgcagttttatttgttttaatattctacctgattatctcagttagactaaaggttttttcgctaattacgaggtatactggatatcaaagttatgtgaaaataggactgagtttgatatccgcttattcattatttttaatcatttcaatgattctatggcagacctttagttatcgtttcatcttagtatccttatttttgtcgtatgtagtgctcattactccgaggattgtttggaaagtcttacatgagacgagaaaaaatgccattcgaaagaaggataacccactaagaatcttagtagtaggtgctggagatggtgggaatatttttatcaataccgtccaagatagaaaattgaattttgaaattgtcggtatagttgatcgtgatccaaataaacttggaacatttatccgtaccgctaaagttttaggaaaccgtaatgatattccacgattggtagagaaattagctgttgaccaagtggtgattgccatcccttctttaaatggtaaggagcgagagaagattgttgaaatctgtaacactacaggagtgaccgtcaataatatgccgagcattgaagacattgtggcgggtaacatgtctgtcagtgcctttcaggaaattgacgtagcagaccttcttggtcgaccagaggttgttttggatcaggatgaattgaatcagtttttcaaagggaaaactatccttgtcacaggagcaggtggctcaatcggttcagagttatgtcgtcaaattgctaagtttacgcctaaatgcttgttgttgcttggtcatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttccattgatggaatataatccacatgaagcagtgaagaataatatttttggaacgaagaatgtggctgaggcggctaaaactgcaaaggttgccaaatttgttatggtttcaacagataaagctgttaatccgccaaatgtcatgggagcgactaaacgtgttgcagaaatgattgtaacaggtttaaacgagccaggtcagactcaatttgcggcagtccgttttgggaatgttctaggtagtcgtggaagtgttgttccgctattcaaagagcaaattagaaaaggtggacctgttacggttaccgactttaggatgactcgttatttcatgacgattcctgaggcaagtcgtttggttatccaagctggatatttggcaaaaggtggagaaatctttgtcttggatatgggtgagccagtacaaatcctggaattggcaagaaaagttatcttgttaagcggacatacagaggaagaaatcgggattgtagaatctggaatcagaccaggcgagaaactctacgaggaattgttatcaacagaagaacgtgtcagcgaacagattcatgaaaaaatatttgtgggtcgcattacaaataagcagtcggacattgtcaattcatttatcaatggattactccaaaaagatagaaatgaattaaaagatatgttgattgaatttgcaaaacaagaataagaaagtaaaaaatatttttactttcctagagtttaaacgatgtttaagttctaggaaggttggaattgctttcgtggaggtgatagatagaaacctatatatttgtagaagaaaggatattaaactaaaggtgaatcggaacataaagtttagatagagttggtatttaatgccaaacaggtgaatgcaacctctcgctcgttactaagcaggagatagtaaagttgcttgaaagagagtttgttaatcagtataagtaggctaaagtgagaatatatatctattattatcggtaatgatactattattgagaattattgtagtggggataaaaataatttttggtgattttatcgtccgacttaaaggtgggttaaaaaagtacttatattcttttagaattgatgaaaaatatgggggaatataatatttataggagatacgatgactagagtagagttgattactagagaattttttaagaagaatgaagcaaccagtaaatattttcagaagatagaatcaagaagaggtgaattatttattaaattctttatggataagttacttgcgcttatcctattattgctattatccccagtaatcattatattagctatttggataaaattagatagtaaggggccaattttttatcgccaagaacgtgttacgagatatggtcgaatttttagaatatttaagtttagaacaatgatttctgatgcggataaagtcggaagtcttgtcacagtcggtcaagataatcgtattacgaaagtcggtcacattatcagaaaatatcggctggacgaagtgccccaactttttaatgttttaatgggggatatgagctttgtaggtgtaagaccagaagtacaaaaatatgtaaatcagtatactgatgaaatgtttgcgacgttacttttacctgcaggaattacttcaccagcgagtattgcatataaggatgaagatattgttttagaagaatattgttctcaaggctatagtcctgatgaagcatatgttcaaaaagtattaccagaaaaaatgaagtacaatttggaatatatcagaaactttggaattatttctgattttaaagtaatgattgatacagtaattaaagtaataaaataggagattaaaatgacaaaaagacaaaatattccattttcaccaccagatattacccaagctgaaattgatgaagttattgacacactaaaatctggttggattacaacaggaccaaagacaaaagagctagaacgtcggctatcagtatttacaggaaccaataaaactgtgtgtttaaattctgctactgcaggattggaactagtcttacgaattcttggtgttggacccggagatgaagttattgttcctgctatgacctatactgcctcatgtagtgtcattactcatgtaggagcaacccctgtgatggttgatattcaaaaaaacagctttgagatggaatacgatgctttggaaaaagcgattactccgaaaacaaaagttatcattcctgttgatctagctggtattccttgtgattatgataaaatttataccatcgtagaaaacaaacgctctttgtatgttgcttctgataataaatggcagaaacttttcgggcgagttattatcctatctgatagtgcacactcactaggtgctagttataaggggaaaccagcgggttccctagcagattttacctcattttctttccatgcagttaagaattttacaactgctgaaggaggtagtgtgacatggagatcatatcctgatttggatgacgaagagatatataaagagtttcagatttactctcttcatggtcagacaaaggatgcattagctaagacacaattagggtcatgggaatatgacattgttattcctggttacaagtgtaatatgacagatattatggctggtatcggtttggtacagctggaacgttacccatccctgctgaatcgtcgtaaagaaattgttgaaaaatacaatttaggttttgaaggaactcaaattaaaccattggtgcatcagtctggagctaaacaatcatccatgcacttgtatatcacacatctggaaggctttactttggaacaacggaacgaagtgattcaaaaaatggctgaagcagggattgcttgcaatgttcactacaaaccattgcctcttctcacagcctataagaatcttggttttgatatgaaagattatccgaatgcctaccagtattttgaaaatgaagttacacttcctcttcataccaacttgagtgatgaagatgtggagtatgtgatagagaatttaaaaaggattatttttgaggttatttaaataataatggaaaaatttttagtttcgattgtgatgcctacatataattgtggtcagtatatttctaaaacaatagaatcgattttggagcaaacatatcagaattgggaattaattattgttgatgatcaatcaaccgataatacaaaggatatagtttacggctatgttaaattagatagccgaataaaatatcatcttttacctaaaaattcaggtgcagcagtagcacgaacagaggctatgaaaaaatcaaaaggtgaatttattgctttttgtgattcagatgatttatggcttccctctaaattatctaagcaattggattttatgggaaaaaataatgtatttttctcatgtacatcatatgagcaaattgatgaaaatggtcttccgcttggtaaaattattaattcagtaaataaagttagttataatcgattattattggattgtccagttggaaactcaactgttatgtataatgtatcgaaaatgggaaaatttgaggtgcctaacatccgtaaaagaaatgatgatgcactgtggttaaaaatgctaaaggtagagccttatatttatggtatgccagatgttttaatgcaatatcgcattaggaaaaattctatttcaagtaataaagttgatttaataaagtatcattggaaattatatcgggatatagaacacctaagcatatttagaagtgtgtttcatgttttagcttgggggataattaaagttttaaaaataaaataggagatatttaggtgaggattcttcaaatttatgatcatgcaggtattagttcaggtattgtatcagtaataatgtcttggcatagatcgaatcttcttgaagatgtaaaatttgattttttatttactaaaaaaattgaaccatcatatgaggaagaaatactaaattgtggtggagaggttttttatattgatgatattgaagaaaagtcttctgtctttacatttataaaaaaagtaaacaagttttttgagaagaacgcttatagatatgatggagttcacttgcattcagctaattttgcatttccatatctatattttgcaaaaaaatacggtattcctttaagaattttacatgttcatagtgtggcattcggaaataatttgttgagcggcattaggaatataccactgatctatttcaataggtttcttgcaaattcatttatagcttgctcaacaaacgcagcaaaaacatggttcggtttactaggtattagtaattttgaaataattcccaatccgttagaagtagaaaagtatggtcaaaatatggatattcgaagggaagtgcgtagccaattaaatataaaagatgacacgattatattaggacatgttagtaatatgactccgttaaaagaagttccatttattatagacgttttagataggttgagacaagatggctttgagtgtaaactagtcttaattggtaaagatgttttaccagcaactgtcaaagataaaattaatatttataatttagaacaagaagtgattaatttgggagtaagaagcgatatagaaatggtgttacatgccatagatgtatgtttgatgccttcgaaatcagaagggtttggtatggtgccactagaatgccaggctgcagatgtaccagtcataatatctaagaacttccctaaagaaataaaagcttcagaaaaggtaagtgttttggaaagagatgtagaactgtggagttcagaggtagtcaaaatgttacctaagcgttttgtatcaaataatttaaataacttaaaatttaatttttctttacaaactgttgtaccgaaattatataaattttatcatagaataactgaataggaagcgtataagttgaaatttaattttaaaattgacataactttttgttttttacaaatattagtagttctgcagtacattaatattatttctgatttattacctaaattcactcaagtagttgtttttgtatgctggtatattttagcgatacgcaacagagatttttttaataaatcacttcatataagtatattgagttttgcaattttttttattaccttattaagaacaattattgccgaccaaattaatatgaattattatagtccgatgcaagcagttatacagaggtatcaattctttatataccctattatatatgtttacgtttgtgatttgcccaaatttaaaaagaaaaaattgattaatttagcttttctatctattttaattactatagcagtatcattttattatatttttaaagtagacccacaagctatcaggaatacacaaaggagtataaaattaattggtgttggtgattttcaattaatgtatgctctgtcactgattactggtccattattaattacgatatttaataggtgggggaaggttcaatttaagcattcttttgaactatcttttattttttgctcggtgctattgtgtttgatattatgtaacttggtaacatctgtaatagtagcgttaatatccatgttcgttgcgttttttttaaattcaaaaagcaaactattccgtttcgttctcatttcagtggttgccctgttatatggattgaaagaacttattgcagattctctatatgcattagctaatcagaatattttttattggagtactaataataaaatagtagccattgcaaatgtattagttggaaatttcgaacaaacagatacattgtctcgtagagatatgttggcgtcgcagtccatggaatcgttttataagaacccagttcttggtattgactttaaaaaccatgttgcaggaaatataggcgggcatatgcagtgggcagatgatttagctagatttggaattgttggtaatttaataataattattaactatataattatagcagtttatactataaaaacgagcaaagataaaatcgttagagactccatgatggcgacttggattacatttgtaatattaggtttccttaatccgttgttatcaggtcctattttaatgatgatttttgttgttattccactattgaacaactattaataattaaatttatgctaaggaagtaagagcaatgagaaggattttattgataaatcaatttaacagtgataacttaggtgataaacttttaagcaatatgatcagtgaatatttagagaagaaaaatttcacggttgataaggtaggttatgctctggaaaaagagcaacaaattgtatataatgatactcaaaaattatctagctatcgtacatttaaaaatagggttccggactttgtcaagtttcatctccaatttaagagaaatctcaagaggatggtatctcgtattgatttgacgaattattctggaattattattggtggtggtcaattaataaaacataagacagttttttcttattgttttagattttggtctggtatagctcagaaaaataatattccattgtttatttatggggtaggagttgactcaggactttcggaaaaagaaattaaaagatattctaaagggatagattatgctagttttattaattgtagagacttagaaagtaaagaattattcagagagttgtttcatgtggatgctgtaattacacccgatgtggcattcggtctcagtgttaatagaatagaaaaagaaaaattaatgattgtgatgccatataattttgaaactgcaaagtattcttttgactatgagatgacggaagaagattactatgctgatttatttgctaaagtgaaagaatactctctaaagaattataaaattgtcttatcctcaacaactacctctgatgctagaactagtttaagttttaaagtatatttggagaaaagagggattgaagctgttatctatgaagcaaaagcaatagatgatttaattcaattatttagtcgttcggaaattattttaacaggacgtatgcatgcaatgattatggggttgtgtacggacaataaaattattcctatactagtttcggataagattcgagtttttgaacaagaatatttgaatgatgattatgattatgaacaaataaaaaaacagagtaatcagggtcttgagcaactgataaatgcattacaggtagaaaaatgagtgatatggatatttcaatagttattccgacttataatagagagctttttttgaaagaagcaatagaaagcattttttgtcagaaaaatgtaagaatagaaataattgttatcgatgattgttccactgataatacagaaactttaataaatgaaatatctaaacgagctccgtcaaatatttgtataatttatcagaaaaatgaatccaagcaatttgcacatatttcacgttttaagggacttgaaattgcaacaggagatatcattgtttttatggatgatgatgacttctatattgatggaagtgtttttgaattagtaaaggatatttttgaaagaaataagagtattggtgcttttattgcatcaactgcaaaatttttgaatggagagtttttacaggggatagatttaaattctgacggaattgttgcaagagatgaatatttgcaacattttggttttaaatatcctaaaccattgtccaccttgagtagtttttttagaacagatttattaaggaattcgggtattaataaatttaaaatggtaaacgatacctgcatatatttaaatggcatactgttaggtgatgtatttgtacataataaagcaattgctgcatatagagtgcatggaacaaatatatctaagtctagattgcctttacgctttattatacaaactctggaggaaaaaaagcgactatataaaaaagttaaactagaagggataataaataatccagctatatggtattttaacaatctgagaaattctatttattattttttggagagttcaaattttgatgtttttataattatttctcagtctatatggttactatttaaagggaatggagtcaggttgttatttttcagagattttttacagagagctttttgtagaagaaagtaagaggttttattttgaaacgaaattttatatatagctcactatatcaagtattgttgctaataattcctctattaaccaccccttatctttcaagagtattgggagctcaagcacttggagagttttcttatcataattcaattgcttattactttgtaattttcataatgcttggtctgaataactacggtagtagagaaattgcaaagaatagagatagtatttcaaattgtagtaggctattttggagcatttacagtttacagatgatattgggaattgctataaattttctatacttagtttacgtagtttttatgtcgaagaattttttattaagttccctattttttatgtataccctttcggcagcaattgatattaattggtttttttgggggattgaagaatttaaaaaaacgacgataagaaatatgttgtctaaattagtagttacactgtctatttttttctttgtaaaagatgagtcggatttaccagtctatgtatttttaatctgtagtaatcttttaattactcaaattatattatggccgtacgtatttcgtaaacttacattttacgttcctaatataaatgaaattttgggccatttgaaaccaaatttatttttattttttacagtattggctgtgagtgtatataagataatggctaaaatattgttaggtgtgatgagctctaatgaacaactaggattttatgaatcatctgaaagagtcattcaagtaccgatggcctttatcactgcactagggaatgttatgttacctaaaatgagtaatctagttgtcaaaaataaggagcagagtccaatcttaattggaaaaagcattagatttgtaatgcttctctcttcatcaatgagttttgggatcatggctgtatctaaagagttcgttccattattttatggggatggttttgaaatttgtatattactatttttaattttattacctagttgtctttttttagcattttctaatgtattcagaacacagtatcttttaccgaatcaaaaagattctattttaatccaatcagtttttattggagctattgtaaatgtagtgattaactattctttaataccttctataggagcggttggagcagccttggctactttaggagcagaatttgcagtaaccgtatatcaaacttttagaataagcaaagagttgaatactcataggtatattatcgaagctatttttatttctatgctaggcttgccaatcttcatttttttatataatctagagtttcacaatgtttccttgatatatagtttatttacaaaaattttgataggattgttatactatagttgtatttttatctggttttataagaaaaactttgtacgaaagtaatattattgttctttgagttattaactaaaattgtaaagagaaatgagtatgaataaaaatatcgccgtcgcaggaacaggctatgtcggtctatctatcgctgtcttattggcacagcatcatcaggttacagctgtggatattatccaagaaaaagttgacttaattaattctaagaagtctccgattcaggatgattatattgaaaaatatctagctgaaaaagacttaaatctagttgcaacgttggatgcagaaaaagcctacaaatatgcagaaattgttgtaatcgctgctccaactaactatgatagtgctaagaactactttgatacaagtcatgtcgaagcagttatacaaacggtactatcggtcaaccctcaagctttgatggttatcaaatcaacgattcctgtaggctttacgcaagcagctcgtcaaaaattcggtactaataatatcattttcagtccagagtttttgagagaatccaaagccttgtatgacaatctctatccttcacggattattgtttcatatgaaaaagatgacagcaaagctgtgattgctggtgcggaaaaatttgctgctttgctacaagagggagctttgaagtctgatattgaagtgcttcatatggggtcaacagaagcagaagcagtgaaattatttgcaaatacctatttagctcttcgtgtttcctatttcaatgaattggatacttatgcggagctaaaaggattagatacagaatcgattattcgaggagttggtttggatcctcgtatcggtgatcattataataatccctctttcggatatgggggttattgcttgccaaaagatacaaagcagttattggctaattacaatgatattccgcagaacatgatgacagccattgtagagtcaaataggactcgtaaggattttattgctgatcaaattttgaagatagctggttattatgattattcgtcacatgatcaatattctcaatcgggagaaaaagaagtgatcatcggtgtgtatcgcttgacaatgaagagtaattctgataatttccgtcaaagttctattcagggagttatgaaacgtctaaaagccaaaggggcaaaagtgattatttttgaaccgactttagagaatggttccaccttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaagctacatttttaattgtgtgtttagatttctaggggagaaggctcgttgctcttctctctcttttttgggctcattgtcaactgtagtgggtagacgaaaagctaacacctagagaggacgaaattcgttctctcatttttgatgttaaaagcaatatatatctttgttttaaagttcgtaaagttcctaaagccgaacgcttgcctcttgatgtctttgatgagtttattggtcgcttccagcttagcgttggaatatggaagctccatggcgttcgtgatgtacgttttatactttagaaaagttttaaaaacagttttaaaggcaggattgacaagatccagcttgtcttctagaagctcgaagaaatatttcgagttcatctcttggaaatggaagagaaggatctgatagagttcgtaatagaatttcagttcctcagagaaattcaatgtcttctggacaacctctctcggtgttactgtttgcccaaaagtgcgagaaaagaagcgattcagagacagttttcgactatctttttggagaatacgccagtgatttttcatggatcgataaggtagggaacgcgtatcgaaagtcttcataatatcaattctagtcgtcatcatagcacggctcaggtattggataatgtgaaatctatcaaggacaattttagctcttggaaatagttttttgatgatgggaatatagctacccgacatgtccactgttacgacctcgacagtttctctgaccgccctaggatacttgtagaaatagttcttgatggtggtttggcggttgttgtcaagaatggtcacaatcgatctcgtctcaaaattctgagcaataaaggcgagttttcccttgttccgactaaattcatcccagctcaagacttttggtaatttcgtaaaatcatgctccaattgaaactgagccagtttcctctggacgaccgatacggagatatgtaatctcctagcgatggctatattggtcatgttttctgtatggagttgtgtcactttctcccaaataggtagggaaatctgacagtttttcttgactagagctgtctcagctacagtcactttttggcaagatttgcattgaaaccgccgtttcttaagcaagaggagggtcggaaagccctgacaatccaaaatcggaatctttgacgacttttgaaagtcgtacttgatacactttccttggcaatgaggacaacgagggctgtcgtaatctagctttgccctgatttctagatgggtctgatgtttcaaaatgaagagaattttgatgtttttgtctttgattccaattagttctgtggtatgatcttcgcttttttatttctaggctcaggaatccagagtcacttccctgactctggatttattccatatgagtctttctaatgtgagtgtggttgcttttcattataggtcatatgggactttttgtatatactcaaaaaggctctataatctctacagtggatttacccactacagaaattatagagccgaaaaacgttccacagtctgcttgactccggaactttttttctatttgcacttattctgaattctttcagcccatggtaaataagcctctagaaccacctttttagcgagtgtttcctcgttaggtagattgtctagaagataggtcatatatttctctgtatcaagttcgtgcctcttggccgttttcaaaagactcaaaatgatagttgtcgacttggctccctcaaaactttgggagaacaaccaattttttctgcccatcaccaaggtcttcatagccctttcagccatgttgttagacaggaccaagtcaccatccgagagaacggtttggatggtggtttcgtatttgaggctatactccaaagcagtacccaatttggagcctggcaaaacagattgctcacgacaccagtcaaagaactcgtccatcaagggagccaactctgtctggcgtttatgcagtcgctcctcgctagacaagtcagcccagtcactctccaaggcaaacaggcggtcgcaataggctaagcccttggctcctaaagaagtcttgtctgccttcttaggagttgcctcaaagaactttcgtctaacatgagcccaacagccaaccagctgagccttgtctaactgccgataagcactccacatgtcacaatgtacatagccagagtaatccccaagaaattcctttacaaccaagccactccgtcgtttgtcatgatgatagagggtgattccctttctctcatgcttcccagacaagaaagtccagtagtaggtcaactggctatcattttctaagaccttgtaggaggtctcatccgcatggagaataggctgctctaacaatttctcgtgcaacaggtcataaatcggttcgaaataatactgactagacttgatgtgccagttggctatttccttccgactgatgggcaaaccaagcttatgccagtcctcttcctgacgataattgggtaccttcagattgaatttctggtgaatggtgtgggcgatgatagaagctgaacccaagctatgtgccagaggagccttaggaacaggagccttgataatcttatcgcttagattcttctgactacatgcctgacacttgtaggcatgttggacatggtcaatccgctttagttgcgcaggaataaagaccaattcttgtcgttgaacagccgagccaatctccttcaactgaccatgacagtctggacaagtgcagtcttccccctgcacttcgtgatgaacaatctctggagtgaactgactaaaaatagcctgacgaattcccttagctttcttgcgtttataggtgatagtctccgtttcaactgggtaagtcagcgtcttcttcaggcaggctttcctccccaaacaagctcagctgaccgggttgatgcactaccttctctgatgattttccgtagagtttctgtctcagatactcaacctgttcacgaaggagggtcaactcgttggtaagttgttcaatcgttgaggtctgttgtttaataattgccaataccattttttgaaacaaggtgttagaattatagggagtaaacaactttactgactttgggttgaatcgtaatcgtaaaggattagtgtggctagctgaagcgatattgtaaaggcacttgaacaaaacttttctagcatagggattgccacgcttggcaatgtgttccttagcgaggaagttaccagattcatagtgtcttaggtcaatcgtaaccgcccaataacaaggtatctatccaatcactccctcctccagtatactgttataaaaaacaaaactggaggattttttatgtcacagctcgtcgtctcattgactattcccaaatctcaccgctttgaaaagaaaagcagaaacgatattctgatgaaaattcgtatcggaaaatcggaagtcacattcttccaatctatcaaccctgaagtaatggaaacaatcttggataaggtgctgtattatgactatccgactcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacactttgttctttaagataatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtaggtttcgcatagctttccgcatagaatgcttatttttagaattttctatttgttggtgagcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggtcccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttactaatgataataaattgttatcggtaggagatgttttatgtattacggtcgcgatactgaaatagaagaattaaaacagcattttaaattttccagtaatgataaaaatagtttatatattattaatggcttaagtggtagtggtaaaaccgagttaatcaaagaggtttgtcaacaagtttacagtcatgataaagaagcgtttattctctacattgatgttacaaatgacgggtttgaaagtaataaattttttgaaaatctactaaaaggagcgtatgtcccaactcaattcagaagaaatctatgcttatcaatacctcaaaaatattcattttcaaattatttaagaaaacaaaaactaacaaatctaactctgaaacatagttttaggttaatcagatctttgatttcattcgatacaacctataaaaaagtaattgattatccttgggaagaagttgttactgaaataaaggagggaatatttgaaagtgatttatatttaagatatttcagtcatgtttcaaaaaaaatccgtctgaatattattattgataattatcaatttttatctgaagatataaaaataaaatttgaagatgactttaatacacttcaaagcggagtctccttaactattataaaccgaacaactgataagttaaaatcaattgataaactagatacattggacaattatactcctactgtattaaatttatcgtatcttactgaggatgagtgtaaattactaataagaaataaaattgctttacttgataatatcaaattgaatcaaatctggcagataacacaaggtaactataaagagattgaattgattattaacagacttattgataatccaaattcagaattatttaatatttctgatatatatgacaaacttccagatattcaaaaaaatatacttctcatatcatcaatttttcctgctggtatgagaaaagatatagtttttaattacattaaatctatagtagatgaaaatattgaagtagctgattctctaaaatcccttattgatgcaggtttcgtatatattaatggagatacaaatgataaaatcaaaatttcacacgaatcaattgtaaatagtattttaaatcacacaaatgcttctgatcttcaattagtaaccaacaatctaaaaatatatttagagcaaactatcttatctataggagttggtggcgagttagcttatttaattcactgcttaataaatatatgtaatattaaagagttacgacaaaatgtagaatatatcaaacagttacttgaaatagaatacaggaaaaattcatatttttacattgcatctttgagcaagaagatacatcatttaatagaattattaccataaaaatacttacattatatattgaactcgtaccagtggatttctgatttcaatggaggcttagctattttaaatagccttcaacaagataattattcaaaagatttacaactatattatcctagatttcaaattcaaaaatatgaatttgaggaggcactaaaatcactggaaaagttagaaaatagctctggaacattactctacaagttaaatgcttatggtcatttaggtaaagatcaagatgcaattaaactccttaatgagaccatgaattctgtagaaaaagacgacttctattatattattttacgaaattctgctcattatttcccaaccaaagaagctaccaaaaatctcgaattagcattggactattttcaacgtaatgaatatcaaatacctgttgcaacagtatataataatctaggtgttgttaatatatgggatgggcaatatgatatagctttagagaatataaataaggccgaaaaaatactaaaaaaatatgattcaaatgaaatttttgaaccatattgtaataaatcaattatttttctgatgaataaaaattatcaacaatctctggaatttataaataaatcacttcaagaatgtcctaaagctttgaccttagatattaggatgctcaagttaaacaaattaattattgagttgatttctgaaaaaatctcttttacagaatttcaaaattcactaaagagctttgaggcagaaattccactcatagacgatccttggtataaatttcaaatagtatacaatttacaacaatttgaagatattccttttgtttatgaaaaaacttatattgatgattatcaagacgggctcaccaaatactatctgttgattccatacaaaaaatataatttctgtataggtctttctcctaattggagatattaatttgttcatggtacttgtgaatgagatctaaatatatggaataatcatattgtttatattttaataaattagctactagtttagctaattttttatatcttcatcagtataggataaatttgtaattccaactgttcctaatctcattcctgaagtcgtcattggtccgtgtgtatcatttggaatttgatttcggttaactaatattttatgctgaaaaagtagattctctgcctccttaccactcaagtttagattcaatagattaactaaaattatatgagtctttggttttttataaacaacatcaaccccctctttacttaattgttttataaacaataaagtattttttataatctgttgagcataatcttgaatatctattgataataatttgattaaacagatacatttcgcaaataatgcagtttgtgtaggcccaccctgtgttctaggaaaaattgaattagttattttttcttcaaatatagaacgatacagtagtactcctccttgaggcccacgtaaacatttatccattgtaaaagtagcgaaatccacatatggaaaaatcgacttatgtagctttgccataatatataaaacactgtggcaaatatccgctaagatgagggtatttgggctaacctcttttataatttcataaatttgttgataattaaattcatttccatacgacgaagcaccaataataatcaatttaggtttatatttatctaataattcctttaattcgatataatcaatatttaagttatggtctaagtgataatattttacagtacctttacctgtataagtatgcaaaatatgtcctccgtcttttggagataacgataaaatataatcgtctctttctaaaacacaattgtagactatttggttagcttgagttcctgaatgtggttgcacattaactctataatcaccaggatttaaatcaaaaagttgaagacacaattcttctgaatatacttcaatattatccaatgaagtacaatgaggaaaaaagcgtttttcaacagctccctctgttggcagagtagcgagagggaaactttgaatctttaatacttcggtgaatggatagctaatacatgcagcaaggtttatcaggctattctgttcttggttatatgaatcaagaattttatttaacttctgatagatttcaccttcaaatttattaattttatacactgatttctcctaccgataacaatttattatcagtagtataccataatctacatttgttttatagattttattaaaatttttatagtaaatatttttagttttttgtttcaaaaatgtaatggagattgatttttcacaagtaattgtcataaaaatcagaaaatattttataaatatgataaaatagaaatgatactagtttgaggtaaggatatgaacttaagaagaagcgtagaaaaactaaagggaac

SEQ ID NO: 57 - DNA, 24367 bp, Streptococcus suis
aagacagcaaaaaacgggacttttaatcccgttttgttttttccttgatccattgactgacgttggacagggccttgctttgctctgccttgcgtttttgttcctggacaaaatctgcaaagctttgcttgacgccatccttttgaaccttgtcctgcaaatcatgccatttctttttaaggttgctggaagtccgttcgtaataaatctctaaaatttcttcttttgacttataattgcgatagaaagcgttgcgagaaactcccgctttacgaaccaattcagatactgaaatttgcttgagctcctttttctctaggagaaatagcagagcagtttctattgattccttagtcagttgattcgcttctttatttgattgatagaggtttttcaaagattggggtgaaattttacgacctgtcatagttttccttttccgagtgtcacatctgaaagaaaatgctttcagatagggtagtttaatgatataattgtaagtaaatagagatttattgtcaaataaaaaagtaaaattggaaatgagaatattatgtcaaaatggaaaattgttgcagattcgggctgcgactatcgtcaattagctaatctagctccggacactgaatttattagtgtgccacttaccatccaagttggagaacaagcatttgttgatgatgcaagcttagatattgatcacatgatggaggtgatggaagcatctaagtctgcagcggggtcggcgtgtccaagtccgcaggcttatcaggcagcttttgagggagctgagaacattatcgttgtgacgattacaggagggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcactatcgggaacacagtaagctcctctttgttttagctaaggttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaatactcaatgaaaatcaaaagtagcctaggaaacgaagtcgaagatagaactctgttactatcttatttcaaggtaacaggctgaaaacctccactggagcttttcactcatcaaggcaagttgacaacggataattttgattttcgaagagtataacaattttggaatgtagtttccactatatagaataatccccctcgtcttttaagttcgagggggattgtttgcatgaggttattaaatttcattcattcaaatatcttacgaattgctccagtttatctgcaaaatcttgttcaaagaagatctgtaagaaatcagctttctgtccgctgaaataataacacttttcaaacatatgttggatgctaggagaaagaatccccttgcttagctgaaaggtcacgctccctttggaaattcgatacgggatgttcaaagtgtatttctctagacaatcttttattttattccactgagcgtgataaatatgatgaagatgctgagtgtttcgtgcaaacataccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatatagatgacatgattatctgtatcaagatagtgtaaaggtaggctatgactagaatcgaaatctgctaaatagtcatcctcaatgatgtagacatcgtattgctttgctaattttacgatggctgtttttgttgctatatcataagttgaaccgagagggttgtgcaagcgaggaattgtgtagaaaaacttgatttttccagtctggaagatattttccaattcttctaggtcaattccatctaaatcccgttcaattgtttgataggggattccttgatgtcgaatgagctctatcattcgtgaataggtagggttctctatcaagatttccgtttttccagctaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccgcccaataagactttcgtttagacaaatccgaaaatcttcatagggcaattcttgaaagtctgcaggattgagctctacagtatggtcttggaaatctctatcttctaagatataataaccgcttttttcgacagcgtaaatcttattttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggccccctttttatagactatgttactagttagtatataggaaaaattgaagaaagacaacatctggatggggttgagtttcaggaattaagctactctatggtataattaagtgatgaaaataattatacctaatgcaaaagaagtaaatacaaatctagagaatgcctcgttttatcccctgtctgatcgaagtaagccggtgctggatgccataagtcaatttgatgtaaaaaagatggctgccttttataaattgaatgaagcaaaggctgagttagaagctgaccgttggtatcgaatcaagacaggtcaagcaaaaacctatccagcctggcagttatatgatggtctcatgtatcgttatatggataggcgagatatagattcgaaagaagaaaattatctacgtgaccatgttcgtatagcgacagccttatacggattgattcatccttttgaattcatttcacctcaccgcttagattttcaagggagcttaaagataggcaatcagtctttgaaacagtactggcgaccgtattatgaccaagaagttggtgatgatgaacggattctctcgctggcttcgtcagaatttgagcaggtattttctccacagattcagaaaagattagttaaaattcttttcatggaagaaaaagcaggtcagctaaaagttcactcgactatatcaaaaaaaggtagaggaagattgctgtcctggttggctaagaacaatattcagaaattatcggacattcaagattttaaggtggatggctttgaatattgtgcttccgaatcaacggcaaaccaacttaccttcatacgatcaatcaaaatgtgaaataatgaacaagataacgttttctgatgtcgagcgtatctagaaaaatcttgatttctatggtataatgggtaagttataagtaaaaaggaaggttgtttatgaaaaagagaagcggacggagaaaatcgtctaagctcaagttgataaattttgcgctttggggactttacgccattactctatgtctattcttagtgaccatgtatcgctataatatcttagattttcggtatttaaattatattgtgacaattctattaataggtgttgcggtgctgacaggattgctgatgtggcgtaagaaagcgcgtgtctttacagcactcttacttgttttttcactctttattacttcagttggagtatatggaatgcaagaagttgttaagttttcgacacgactaaattcaaattcgacattttcagaatatgaaatgagcatccttgtcccagcaaatagtgagattacagatgttcgtcagcttactagtattcttgctccagccgaatacgaccaagataacatcaccgctttattggaaaatatttccaaaatggaatctactcaactagcaactagccccgcaacctcttacctgacagcatatcaatctatgataaatggtgagagtcaagcgatggtcttcaatggagttttcaccaatattttagaaaatgaagatccagacttttcttcaaaagtaaaaaaaatatatagtttcaaagtgactcagactgttgaatcagctactgagcaggtgagtggagacagttttaatatctatataagtggtatagatacttacggtccaatttcatctgtttcgcgttcagatgtcaatatcattatgactgtcaatcgtgcgacacataagattttattgacaactactccacgagattcatacgttgctattgcagatggcgggcaaaatcaatacgacaaattaactcatgctgggatttatggtgttaacgcctcagtgcacaccttagaaaatctttatggtattgacattagtaactatatccgactcaactttacttccttcttgcagttgattgatttggttggtggtattgatgtagaaaatacccaagaatttacaagcggagggtataatttccctgttgggacagtgcatctagatgcagagcaagcgctaatctttgttcgtgagcggtattcgttggctaatggtgataatgaccgtggtaaaaaccaagaaaaagtcattgcagccctcatcaaaaaattgagttcaccagagaatttacgcaattatcaagctattctaactggtttggaagggtctatccaaacagatttgagcttagaaacgattatgggcttggtaaatacccaattagaatcaggaacacaatttacagtagagtcacaagcattgacaggaacaggacgctcagatttatcttcttatgcgatgcctggatcacaactttatatgatggaaattaaccaagatagtctggagcaagcaaaggcggcgattcagtcagtattggatggaaattaaaaaaataggagaaaacatgaataatcaagaaatgaatacaatcgaaattgatattttactcttactgaaaacgatttggagaaagaaatttcttattatcatcacagctctttttggagcagggattgcttttgtctatagtagttttttagtaacccctcaatttgactccactacacggatttatgtagtcagtcaaaatgttgaggcaggagctggtttgacaaaccaagaacttcaggctgggacctacctcgttaaagactataaagaaatcattctatcacaagatgtgttatcacgagtaaaaacagagctaggattgacagaggacatatcaaataaaatatctgtcagcatccccgttgatactcgtatcgtttctatctccgtgcgtgatgcggatccaaatgaagcggcacgtattgcaaatagccttcgcacctttgcggcgcaaaagattgttgaggtcactaaagtaagcgatgtgacaacacttgaagaagcagtcccagcggaagaaccaaccactccgaatataaaacgcaatatcttgcttggtttattagctggaggtatcttggcaacgggaattatcttggctatggaagttttggatgaccgtgtcaaacgccctcaggatattgaagaggtaatgggcttgaccttgcttggtgtagtaccagattcgaagaaattgaaataggagaacaatatggcaacgttagaaattgcgcgtacaaaaagagagatagtaaataaaaccgaggagtatttcaatgccatccgtaccaacattcagcttagcggagcggatattaaggttgttggcattacctctgttcagtcaaatgaaggtaagagtacaactgcggctagtctcgctattgcctatgctcgttcaggttataagaccgttttggtggatgcagatatccgaaattcggtcatgcctggtttcttcaagccaattacaaagattacaggtttgacggattacctagcagggacaacagacttgtctcagggattatgcgatactgatattccaaacttgaccgtcattgagtcaggaaaagtttcacctaaccctactgcccttttacaaagtaagaattttgaaaatttacttgcgactcttcgtcgctattatgattatgttatcgttgactgtccaccattaggactggtaattgatgcagctatcattgcacagaaatgtgatgcaatggttgcagtagtagaagcaggtaatgttaagcgctcatctttgaaaaaagtaaaagagcagttggatcaaacaggtacaccgttcttaggcgttatcttgaacaaatatgatattgccactgagaagtatagtgaatacggaaactacggaaattacggcaaaaaagcctaatttctcagataatataagtttgataagtaggtattaatatgattgatattcattcgcatatcatatttggtgtggatgacggccccaaaactattgaagaaagcctgagtttgataggcgaagcttatcgtcaaggtgttcgctatatcgtagcgacatctcatagacgaaaagggatgtttgaaacaccagaaaaagttatcatgactaactttcttcaacttaaagcagcagtagcagaagtttatcctgaaatacgattgtgctatggtgctgaattgtattatagtaaagatatcttaagcaaacttgaaaaaaagaaagtaccaacgcttaatggctcacgctatattctcttggagttcagtatgaatactccctggaaagagattcaagaagcagtgaacgaagtgacgctacttgggctaactcctgtacttgcccatatagaacgatatgatgccctagcgtttcatgcagagagagtagaagagttaattgacaagggatgctatactcaggtaaatagtaaccatgtgctgaagcccgctttaattggcgatcgagcaaaagaatttaaaaaacgcactcggtattttttagagcaggacttagtacattgtgttgctagcgatatgcataatttatctagtagacctccgtttatgagggaggcttataagttaataacagaggaatttggcaaagataaagcgaaagcattgctgaaaaagaatcctcttatgctattaaaaaaccaggcgatttaaactggttactctagattgtggagaaaaaatggatttaggaactgttactgacaaactgttagagcgcaacagtaaacgattgatactcatgtgcatggatacgtgtcttcttatagtttccatgattttgagcaggctgtttttggatgttattattgacattccagatgaacgctttattcttgcagttttatttgttttaatattctacctgattatctcagttagactaaaggttttttcgttaattacgaggtatactggatataaaagttatgtgaaaataggactgagtttgatatccgcttattcattatttttaatcatttcaatgattctatggcagacctttagttatcgtttcatcttagtatccttatttttgtcgtatgtaatgctcattactccgaggattgtttggaaagtcttacatgagacgagaaaaaatgctatccgtaagaaggatagcccactaagaatcttagtagtaggtgctggagatggcgggaatatcttcatcaatactgtcgaagatcgaaaattgaattttgaaattgtcggtatcgttgatcgtgatccaaataaacttggaacatttatccttaccgctaaagttttaggaaaccgtaatgatattccacgactggtagaggaattagctgttgaccaagtgacgattgccatcccttctttaaatggtaaggagcgagagaagattgttgaaatctgtaacactacaggagtgaccgtcaataatatgccgagcattgaagacattatggcggggaacatgtctgtcagtgcctttcaggaaattgacgtagcagatcttcttggtcgaccagaggttgttttggatcaggatgaattgaatcagtttttcaaagggaaaacaatccttgtcacaggagcaggtggctctatcggttcagagttatgtcgtcaaattgctaagtttacgcctaaacgcttgttgttgcttggacatggagaaaattcaatctatctcattcatcgagagttactggaaaagtaccaaggtaagattgagttggtccctctcattgcagatattcaagatagagaattgatttttagcataatggctgaatatcaacccgatgttgtttatcatgctgcagcacataagcatgttcctttgatggaatacaatccacatgaagcagtgaagaataatatttttggaacgaagaatgtggctgaggcggctaaaactgcaaaagttgccaaatttgttatggtttcaacagataaagctgttaatccgccaaatgtcatgggagcgactaaacgtgttgcagaaatgattgtaacaggtttaaacgagccaggtcagactcaatttgcggcagtccgttttgggaatgttctaggtagtcgtggaagtgttgttccgctattcaaagagcaaattagaaaaggtggtcctgttacggtcaccgactttaggatgactcgttatttcatgacgattcctgaggcaagtcgtttggttatacaagctggacatttggcaaaaggtggagaaatttttgtcttggatatgggtgagccagtacagatactagagttagctcgaaaagttatcttattaagtggtcatacagaagatgaaattggaattgtggaatctggaattcgtcctggagagaaactctacgaagagttactatccactgaagaacgtgttagtgaacaaattcacgaaaagattttcgtcggtcgtgtcaccaataaagaagaagaggtcgttcaaacctttatcaatggtctcctattaaaagataaggaagaactgagaactgccttgcttgaatttgcaaaacaagaataagaaagtaaaaaatatttttactttcctagagtttaaacgatgtttaagttctaggaaggttgaaaaactttccagaggtaagatatgttaggtcataggttagtaagagaaaaagaaaacagaatcaaaggtggtctttaccataaggttcaaatagagttggctttcaattcaaaccatatcgaaggtagtcagctgacccatgaccagacacgatatatctatgagactaatacgattggttttgaagacaatccaactattaaggtggatgatattatcgaaacgaccaatcattttacggcttttgattttctattagatagctttcaagatgatttgaatgaaacttggataaaggagattcatgctatcttgaagagaggaacctctgattctcggaagtcatggtttcaagtcggagactataagtcgtacccaaatgaagttggcggacgtgaaacgactttgccagaaaaagtagaatccgatatgcaagaattgctaaacagctatcatcgcttgcctgagatttcctttgaggatattcttgactttcatgttcgatttgaacgcattcatccctttcaagatggtaacgggcgagtaggtcgattgattatgtttaaagaatgtctcaaacatggccatgtcccctttatcatcggagatgacatgaagtatttttactatcgtggcttagccgagtggggagagcagaatggtttcttgctggatacttgtctagcagcacaagataggtttagacaatatttagattattttagggttgaggattaaggattaaggagattggaatgtatccgattattaagcgtattttatctgttattatttcagggtgttccattattgttttaagtccagttctattattagttgcactggcaatcaaactggattcaaaaggtccagtactatttaaacaaaaacgagttggtaagaataagaaatacttcatgatttataagttccgttcaatgtatgtggatgcaccaagtgatatgccaactcatttattaaaagatccgaatgctatgattactaaagtaggaggctttcttcgaaaaacgagtttagatgagcttccgcaactatttaacattttaaaaggtgaaatggctattgtcggacccagaccagcattgtggaatcaatatgaccttattgaagaacgtgataagtacggggcaaatgatatccgacctggattaactggttgggctcaaattaatggtcgtgatgaattggaaatcgatgagaagtcaaaattggatggatattatgttcaaaatatgagtctagggttggatattaaatgtttctttggaactttccttagtgttgctaagagcgaaggagtagtcgaaggcggaacggggcagaaagggagataatgaagttttcagttttaatgtctgtatatgaaaaagaggatcctaattatttgagaaattcattggaaagtattcttattaatcaaactgtaattccaacagaggttgttttagttgaagatggaccgcttactggtggtttatattctgttttagaagaatttaaaagtcggttctctttttttaaaactatttcattgaaaagtaatgtaggtttagggaaggcgctcaatgaggggttgaaacattgcagttttgaatgggtagccagaatggattctgatgatatagcagtaaataatcgatttgaaattcaattaaattatttggaaaaatatccttctttagatcttttaggagggagtattattgaatttggaactgcgcttgatgatataaaatcccaaaagtctataccaacggatgaaaaagatattataaactatagcaaaacaaggaatcctttctgtcatatgactgttttttttaaaaaatctgcagtacttgatgtaggaggctatcaacatctcccctacgtagaagattattatttatgggtaagaatgcttgctgcgaataaaagagttgcaaatctacctgatattcttgtctacgctcgtgtagggaatggattggcagaaagaaggagcaatagagctcaaattgttagttggaaaattttgaatgatttcatgttagagcaagggatgatttcaaaaatgaactacattaaaaatatgatctcaattagactatttgtttatatcccggctggtatcaagagaatcatttataggcatatcttaagataaatgaagttatataaagccaatattttgaaaaaaggagaattttatgaagattttagttactggagcagcgggctttttaggattgggtattgttaagaaacttcttgatgatggtatggaagttattgctacagacattaacacttctcaggtggatgaaagagctgagcgaatagatgcagatttatttaatttaaaagatccttataatttttttggaaaaccaactaagctactccatctagcatggcgtgatggttttcaacataattctttagctcatatgaatgacttgaatgcacatttccagtttctaattaatatgatggagaatgggacgacggatgtttctgttttaggtacaatgcatgaggttggattttttgaaggcccaatagatgaaaatactatttgtaaccctctgagtttatatggaatcagtaaaaacgctttacgtcaagctatcaacattgaggcgcctaaatatgattgtaagattaaatggttgagagggttttacatagttggaaatacagatacgggatcatctattttttctaagattgttcaagctagtaaacaagggaaaatattgtttccatttacttcagggaaaaacaaatatgattttctaaactatgcggatttttgttcacaagtaagtgcaacagtacagcaatcagaaatctttggcatcattaatatttgttcaggagaacctattagtctagcagatagagttgaattgtttattaaagaaaataatttgaaaatccagttagaatatggagtttttcctgatcgagcttatgattcaaaagctatttggggtaataatgagaaaataaaacaaattatgcagaactataaaggagagtatggggaatgagcgaggatgtagcaattatattacctatttttgatggctatgaggatatgtgggaggattgtatccgtctcataaagaaaaattggaaggaccacccagctatttacgtattttcaaatgttcttcaaaaagattgggaaggagttacctgtatccccgtaggagaggatgcggaatggagtaagaaaattcaaaaagcaattgatgttgttgatgaaaaatattttatattgatgctagaggatttttttataggtgatgtagtgaaagcaaacttagttgatgagttgatcgcttttatggaaaaaaatggaattgatttctgcaaattatgtgataataacaatattgtaaagaagagaaaagataaatttgattctgcctatccttatcaagtaatttttgaagatgaagaatatgggatttctctacagacgtctatttggaggaaaacatttttagaaaaacttgtagggcgagaaaattataatgcttggcaatttgaattaaatcaggtaaaaatagctcgaaatgcgaaccatataaaaatgcaaaatgctatttttgatcctagaaatatattgaatattaaacatggagcgttgcagggacagttgttgccccccactgtaaaatacttcgaaaaaataggggatccattgaattgtcaaagacctattatgacaaggaagacctatttacaatattggattaagcaattgggaagagatttgacaccaaaagttgcaaaggggattgtcaaaagtattggtcgacaatttggtatgaatttcgttgaagataagtggatgactaaggatgaaaaaaatagttaaaagattttatatgttagtgcggcacccaattatttttctaaaatcatttaagaaaaatttttatattagaggtaaactaaatataaatcatttttcaagaatcgtattgggaaatgacatcacttttggatatggaacaaggattaatttttacagtaataattcagataataaaggaaaactctttataggtgacaattcatacttttgtcataataatactatattagtgggaggggatattcacattggaaataatgtattagttgcaagtgaggtggctattttttcagaaaaccactcaactaatttagaaactaatactccatatatgaatcaatcattaaaaatgagtgaagtagttattggaaataacgtttggattggagagaaagctattatcctaccaggtgtgcatattggagataatagtattattggagctggtagtgttgttacaaagagtgttccaagtaatacagtagtgggggggaatcctgctaaacagattaagtattatagcgagaaagagaaatgttggaaaagaacttgaacaatgggaaaaaaatttgtatattaatgaccacatataacccaagtaattatctttatgaacaattggatagtatatttgagcaagaaggggtagaattagaagttattatccgtgatgatgcctcaacacagaaggatattttacgagatgtgcagcataaatatcctattactttgttagaaggtaaaaaaaatcttggagttgctggaaacataaaagaattgttactttatgtagctgaaaacaagagggaatatgatttatttgcttatagtgaccaagatgatgtatggcttcgagagaagatgaaaaaagctatttcagcacatgaaaacctgaacccggaaaaaccaggagtttattactcaaatttacaagttgtggatgaattcttaacacctactcacaaattatttaaaaaaggtattgtaaaaaattcatttggacaatcattagcacaagtttttttatttgcttgtacttctgtgtttaataagattatgttagatgagcttataaaatataatttttctgatttaggttttgattcgctgttatactatcttggtattttaaatgaaaatattatatatgatgatactccctacattttttataggcagcatggacaaaatgtttcaggtcaaaaggaacaagggctcaagtatataaaaaataagcttattcatttttttaatcaaagtgagagagcagttatgaaaaataaagcacagtacatagtagagaacctgagtccgtatttatctgagaaaaattatttattagctcatcaagtttcagcatacagtggtcttttaagtcgcttggcattgattggtaattcagatatacaagcggggtactatccgaaagatatataccgttggttacgcttgttactgggccgatattagattggtataactatgttaattattactttatttattttaacagtacttttattttttttaataataaggaagaattttacctcacctttatttttatttacgattttatggtgtacagtaattggtttttacagtcttcgtttgtatggtatttttgatattcaaaataatactaaagcagtgttgcttggtggaatactgtcatttttgggaggctatggacttcattcactgctatcttcaaaaaaaagtaaggaagataggaattacttcgacagacctaattatataagaattagttggcttgttgtttttattataattctttcactagacttctactcccagcagctgcgttatgcactacaaggggttcctttggatgagactaaaattttactatcattaggaaagattgatactggtggttggatcatgcaatatatagtgagaccttttgagcatattattattgcactcgctagttattgtgtgttccataaaaaagatgagaaaattattattttatcaggaattataacaactttactgagatttattgggacgggtagtaaagttatacttgtttatctattgatatgcctatttttttcctaccttctaacacctattttagaaccagagataaaaataaagagacagtttagattaaataaacgagggaagttttacttaattggccttggtttaggagtggtagcatttttattttattatatgagtagagatagcaatgtaatccaatcgctttatttttatattagtggttcggtagttttgctagataaagtactcaatacttccttttattttgatggtaattataactgggggtttaattcttttaatagtctagtaagattagtagttaaattggcttcaatgataggtatcaatttggagggcgaacttcttactaggggaacctacacaatgattagatatgatttaacgaactatgtgtctaatactagaccttataatgcctttgtaactatgtttgcaaatttttatgttgattttggctatgttggagtagttggcttatcatcactctttggaatcttttcaagttggcaatatcaaaggttaatgaagaaaccaggaattattaattacgttatttattgtattacagcttactatattctttatagtatggtacgtttccaaatgatgatattgccatggggattatctatgctgtattcgcttttcttattgccagtattacttaatgttagagtaaagattgggaataaatatatttaggaagggacagatatgaaaagctcaaaaaaaaattttttctatcaagctttttatcaagttctaattttaatgattcctctgttcactacaccatttttaacaagaaccatgggaattgaggctttgggagaatattcattttattactccattgcctactattttgtaattgttattaaattggggctagataattatggtaatcgacaaattgcaaaaataagagaggaaaaagagcaactatcacaaaatttttggggaatatactattttcaattatttattggtattgtaattagtgcaatttatattttattaatatttttagatagtgatgatctatggatcaaaatttcaatgattccattattgttatcttccgtaatagatattacttggttcttttacggattggaagaatttaagattacagtccttcgtaatacactaatcaaattgggaactacagttttaatttttttattaattaaaagtgactacgatctcctcctgtactcttttttattatcgctatcaaattttttcagccaattatatttgtggttttttctttcaaagcgagttacatttaaattaccacatgaagtaaaaattctacatcatataaagccaaatttaattctatttttaccagtattggcagtcagtatatataaaataatggcaaaaattcttttgggatacatgacaaccgcaacacaagttggctattttgatagtagtgacaaagtaattcaaattcccttagctttagtaacttcattgggtacagttatgatgcctagaatgtctaatttatatgctaaagaatcattaaaagatgctgatagagttttttctcagtcgatagaaattgcaatgttcttatcaactgccctaggttttggtttaatgggagtagccaaaacttttgttccatggtattatggagaaaattttggtgttgtcattattttatttcaaatactgttacctagtagtatattcttagcatttgcaaacgttatacgaacacaatatttaattccaaattctagagataaagtgtatattactactttatttttaggagcaatagtaaatttactggcgaatatactactgattccacaatatgcggcaataggtgctgctatagcaactttaattgcagaagttgttgtttgtttaagccaggcatatagcattagaaaagaaataccgattgtaaaatattttcaattggctcttaagtatgttgtatcaggattcgttatgtatatagtagtggtacaggttgactttctgaagttgagtccaatttttagcttagcgattcaaattctaattggttttttcatatatatgctatccctcttcctttttttaaaccaacaaaagcgaagcatattagtgaaaagaattttgaatgttataaaatatgggagaaagaatgacagatttaactaagaaattttcttttattatacctatttacaatactggtattgaaattattgaaaagtgtatttgttcaattcttggacaaagaataaataactttgagattatacttgtcaatgatggtagttcagataaggtaattgatgatttttgcaaagatttggaatcaactgaatcaggattaatttatatataccaagaaaatcaggggtcagcagttgcaagaaataaaggattagatatggcaacgggtgattacatattttttgtagatgcagacgacactttagttgaggaatcgtttcagaaataccttaatctatctgaagaagttgagataacttgttttgactatttaataacagatggacaaaattctacaaattattcactcaatagcaaaatggacttatccaaccataagaatcgactatatgctaatataatgtacaagccaggagtcctagatgattttgcatttggtgccatatggggcaagtgtttttctaggcaatttcttgaaaaaaataatattcgattcagacctgaacttcgtaaaacacaagatcgtatttttatgttggaagcttttttacactcttccaatatactatatttaccgattccattttataattatcatgtcaatccaaattctataactcatgtaaaaaattttaagatgttggattactgtgagcggttgataaattgcttcaatgacttagttgagcagtatcctgaactgaaaaaagacagtaaatatttcacttataatatttttcaggaaatgttattacttacctacttaaataaatatagtgatttttcgtctaaaatttatgtgtcagaaatcacaaagatttataaacgatttaaacttgacgaaggactaagagaaattaattatcaagattttaataattctggagaaaagattaagctatttctatataaaaaccgattctttagagttctaaaatattattattcaagagtcaaataattatataaggaaaggactggttagagattgtttatgaaacatagattattttatcttgatatattcaaagtaattggcttattgtgtattgttttagctcatgtatttcctccacaaattatatttcaagcgaggaattttgatgttatcttgatgatagtgatatcaagtatgcttttcttttattcgaatagacaaataagtttttggtcatatgttggcaaacgttttgaaagactagtgattccaacctggatatttctagctatatttttttcattatccatactgctcttcccaaattatttgtcattaaaactagttgcaacaagttttgcactagaaggaggtattggctatgtttgggttataagaatttattttattattgcttgtttgctcccgtttataaagtggctgtgtagtacttttaagaaatcgttcatttacataggaacgctatttctttatgtattctatgaagttctttgccattttaatgtattcaatggcacacttacgcagtatctatttgcttattggattccatgccttgtgattggagttgtctcatactggatgattcaagctgaatcaaaaatgttattctatttctcaattctaaatctatcagtattctttttaatatgctatatttattatttacaaacaggacaatttgtaaattctaatataatgaaatatccatttcgtttatactatcttagttatggcttttcaattacaggttttctgtatttaagtcgtaagtttttagagtattttttaaaaaaaatagaaccacaaataatgtttatttcaagtaattcactttggatatatttatttcatatccccttcgtaatttacttaagtaaatattattcctcattgaattggggagttaaatttttattaaccctattttcttcaattttgatagttcttataaaaaatctgatcattacctatattggtaaattcaataaaactaaactattggaatattttaaaggttaattaatttttgttaatataaaaatcaaaaagacaagaatttcacaaaatagataaattcttgttttttttattaacataagatataataagggtacccatattacggaaaggtttgtttcaatgaaaagattttcaacgcgtaaattgtcaaatttagtctttaaaggccgtaaggaaaaaaaatggacacaacaagagttatcagatctaacagggattaatagatcgatgataagtcgtttggaaaaaggggagtacgaaccaagtattgcccaattggaaaaattagctgatattttaagtttttctattgatgaagtattttataattcatcaaatattctttctcctgttgaagcaggtagaattattaaaatcgccgtcgcaggaacaggctatgttggcctatctattgctgttttattggcccagcatcatcaagtcacagctgtggatattatccaagaaaaagttgatttaatcaatgcaaagaagtctcctattcaagatgattatattgaaaaatatcttgcggaaaaggacttgaatttagtagcaacacttgatgcagaaaaagcctacagagaggcagaaattgttgtgattgctgctccaacgaactatgatagtgctaagaattactttgacacaagtcatgtggaagaagttattcaaacagtattatcggtcaaccctcaagctttaatggtaatcaaatcaacgattcctgttggctttacccaatctatgcgtgagaagtttggtacagaaaatattattttcagtcctgaatttcttagagagtcaaaagccctttatgataatctttatccatcacggattattgtatcttgtgaagatggtgcgccagattcggtagtagaaggttcaaagttatttgcttctcttctacaagaaggagccttgaagaaagatgtggaagtgttgcatatgggatctacagaggcagaggcagtcaagctttttgccaatacctatttagccttgcgcgtttcctacttcaatgaattggatacctatgcagagttgaaagggctggataccgaatccattatcaagggtgttggcttagatccacgtattggtgaccactacaataacccttcttttggctatggtggttactgtctaccaaaagataccaagcagttgttggcgaattacaatgatgttccgcagaatatgatgacagctattgtagagtcaaataggactcgtaaggattttattgctgatcaggtactgaaaatggctggctattatgattattcgtcacatgatcaatactctcaatcgggagaaaaagaagtaattatcggtgtgtatcgcttgacaatgaagagtaactctgacaactttagacagagttccattcaaggtgttatgaagcgattgaaagccaaaggtgctaaggtgcttatttttgaaccaacattagaagatggttcaactttctttggttcaaaagtgattaataatttgaatcagtttaaatctaaaagtcacgcaattgttgcaaatagatacgactctgtcttggatgatgtattagataaagtgtatacgcgtgatatttttagaagagactagtcttctaaaaatacatttttaattgtgtgtttagatttctaggggagaaggctcgttgctcttctctttcttttttgactgtatgaacaataagtctggtaatctagctgtcactaattgtaattgaaataggcgtgttagattgatacaattgttgataaacagaaataaagacttactttgtttcttgttagggaatatataaatgtaattttcagaggtaaataatgtcgtacgattatctagtagtcggagcaggtctgttcggtgcggtctttgctcatgaggcagctaaaaagggtaaaaaaataaaggttatcgaaaaacgagaccacattgcaggtaacatctatacaaaagaagtagaaggtattcaagtccatgaatatggcgcgcatattttccatacttctgaaaaagaaatttgggattatgtgaatcagtttgcggagttcaaccgctatacaaacacaccagtcgctaactacaagggtgagatttacaatcttcccttcaacatgaatacctttaacaagctttggggtgtggtgacccctgctgaagcagcagcgaagattgcagagcaacgagctgttttgggaggaaaaacacctgagaacttggaagagcaagccatttcacttgttggtacagacatctatgaaaaattgatcaagtcttacacagaaaagcagtgggaaaaaccttgtacggaattaccagcctttatcatccgtcgcttgcccgtgcgtttgacttatgataataactactttaacgatacttatcaaggtattccaatcggcggttatacgcagattgtagaaaaaatgttggaacatgaaaatatcgatgtggagacaaatgttgatttctttgccaataaggaagactatttagcgacctatccgaagattgtctttacaggaatgattgacgagttttttgattaccaacttggtgaattggaatatcgtagccttcaatttgagacagaagtattggatatggaaaactatcaagggaatgcggttgtcaactacacagatagcgagacaccgtttactcgaatcatcgaacacaaacatttcgaatttggtacacaaccgaaaaccattattacccgtgagcactcgaagacctggaaacgaggtgatgagccgtactatccagtgaacaatgatcgtaacaacaaactctatactgcttataaacgcctcgcagaacaacaagagaatgttatattcggcgggcgtcttggtcattatcgttactacgatatgcaccaagtcatcggagctgccttacagtgtgtgagaagtgaagttggggaatgattttgagaagtcatcaaagtagtaattgattcttggcagaagttggaatgctctctaaatgttaatcaaaaaaaaccagaaattctggtttttttgattattattgaattgctgccaacaggtcagctgcttgttgttcgagttttgctagagtttcgtcagataactccaatacacctgttccccatgcttcgggattgatggttgaacctgtaaattcaccagcaatctgagtacggataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaagaatgcttcggcttttttggccatttgatggttaaaagaaccgtcacgtagtgaaccaactaaaaacaatacgtttgccatgatggcttccttttcataaaaacataaatttagtatatcgtatttgtcttttgttggcaatcctaggtctgctgatttttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttttttataacgacagtcatgttgccagaagtacttaataatttatcaattaagtcttgaattcgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtactttctatagcatagaggagctgaactgtgggtcccagttcttatattcgttctctgtctgaaagagaatgaaagtttattcacaattcaattacggaaaaaatggaaatatactttaacttgtagtataataggactactatggaaaaaaagatttttcaacttttggaagcattggcaacgaagaagggacagctgatagctggttcctttatacttctaagtgtcatgactttttcgatattcgttatttgggaccttgcagctaagcctttttctgatgtacagaatcacgctatttctgtagctcgagactatacggatatagaggttgttgatgatgtctctatctacaacgggacagaaacatactttagcgtgcaaggaaagacgagtcagggtgaaatgattgcggttatcattcctgaagagacaaatactgtgtacgtttatccaatggcgaatgggatttctaaggaagaagcgcaggcagtcgctacagagaatggtgcgtcagcagctgatagggtgattctaggttttagggatgacaaaccaatttgggaagtcaaatctgggacagcttattatttagtaaattttgaaacaggagattttatcaagaaggagggcttatga

SEQ ID NO: 58 - DNA, 18672 bp, Streptococcus suis
attacaggtgggctatcgggtagttttaatgcggcacgagtagctagggatatgtatatcgaagagcatccggatgtgaatatccatttgatagatagtttgtcagccagtggggaaatggatttacttgttgacgaaatcaatcgcttaattggtgcaggattagattttccacaagtagtagaaacgataactcactatcgggaacacagtaagctcctctttgttttagcgaaggtcgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagtttttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattgtttgtatgagactattggatttcattcattcaaatatcttacgaattgctccagtttatctgcaaaatcttgttcaaagaagatctgtaagaaatcagctttctgtccgctgaaataataacatttgccaaacatgcgttggatgctaggcgaaagaatccccttgcttagctgaaaggtcacgctccctttggaaattcgatacgggatgttcaaagcgtatttctctaaacaatcttttattttattccactgagtgtgataaataagatgaagatgctgtgtgttccgtgcaaacataccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatatagatgacatgattatctgtatcaagatagtgtaaaggtaggctatgactagagtcgaaatctgctaaatagtcatcctcaatgatgtagacatcgtattgctttgctaattttacgatggctgtttttgttgctatatcataagttgaaccgagagggttgtgcaagcgaggaattgtgtagaaaaacttaatttttccagtttggaagatactttccaattcttctaggtcaattccatctagatcccgttcaattgtttgataggggattccttgatgtcgaatgagctctatcattcgtgaataggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtaaatcttattttggtattttaattccaacatagccttttggacagtgtctttgctacaatgatattgctcgctgagttgacggatagaaggtaatttctctccacgtttgaatcgatgttcctctattccagtcaaaatatcttggataataacttgatattttttcatctaggcccccttttttatagactatgttactagctagtatataggaaaagttgcagaaagacaatatatgaataatggggttgaggttcaggaattaagctactctatggtataattaagtgatgaaaataattatacctaatgcaaaagaagtaaatacaaatctagagaatgcctcgttttatctcctgtctgatcgaagtaagcaggttctggatgccataagtcaatttgatgtaaaaaagatggctgccttttataaactgaatgaagcaaaggctgagttagaagctgaccgttggtatcgaatcaggacaggtcaagcgaaaacctatccagcctggcagttatatgatggtctcatgtatcgttatatggataggcgagatatagattcgaaagaagaaaattatctacgtaaccatgttcgtgttgcgacagccttatacggattgattcatccttttgaattcatttcacctcaccgcttagattttcaagggagcttaaagataggcaatcagtctttgaaacagtactggcgaccgtattatgaccaagaagttggtgacgatgaactgattctctcgctggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcagaaattatcggacattcaagattttaaggtggatggctttgaatattgtgcttccgaatcaacggcaaaccaacttaccttcatacgatcaatcaaaatgtgaaataatgaacaagataacgttttctgatgtcgagcgtatctagaaaaatcttgatttctatggtataatagataagttataagtaaaaaggaaggttgtttatgaaaaagagaagcggacggagaacatcatctaagctcaagttgataaattttgcgctttggggactttacgccattactctatgtttgttcttagtgaccatgtatcgctataacatcctagatttccggtatttaaactatattgtgacgcttttgctagtaggagtggcagtattggctggaatattgatgtggcgaaagaaagcgcgcatatttacatcgctcttacttgttttttcactggtcatcacgtctgttggaatctatggaatgcaagaagttgtaaaattttcaacacgactaaattcaaattcgacattttcagaatatgaaatgagcatccttgtcccagcaaatagtgatattacggacgttcgtcagcttactagtattcttgctccagacgaatacgaccaagataacatcaccgctttattggatgacatatccaaaatggaatctactcaactagcaactagccccacaacctcttacctgacagcatatcaatctatgttgaatggtgagagtcaagcgatggtcttcaacggagtttttaccaatattttagaaaatgaagatccagacttttcttcaaaagtgaaaaaaatatatagtttcaaagtgactcagactgttgaaacagctactgagcaagtgagtggagacagttttaatatctatattagtggtattgatgcttatggaccgatttctacggtctcgcgttcagatgtcaatatcattatgactgtcaatcgtgcgacacataagattttattgacaactactccacgagattcatacgttgctattgcagatggtgggcaaaatcaatacgataaactaacacatgctgggatttatggtgttaacgcctcagtgcacaccctagaaaatctttatggtattgacattagtaactatatccgactcaactttacttccttcttgcagttgattgatttggttggtggtattgatgttgaaaatacccaagaatttacaagtttacatggaaattattattttcctgttggtcaagttcacttaaatgcagagcaagcgctaggttttgttcgggaacgttattcacttgagggaggggataatgatcgcggtcaaaaccaagaaaaagtcattgcagccctcataaaaaaattgagttcaccagataatctagcgaattatcaagctattctaactggtttggaaggatctatccaaacagatttgagcttagaaacgatcatgggcttggtaaatacccaattagaatcaggaacacaatttacagtagagtcacaagcagtgacaggaacaggacgctcagatttatcttcttatgcgatgcctggatcacaactttatatgatggaaattaaccaagatagtctggaacaagcaaaggcagcgattcagtcagtattggatggaaattaaaaaataggagaaaacatgaataatcaagaatcaaatacaatcgaaattgatgtattatcattattgaaaacaatctggagaaaaaaattcttcattctagtaactgcggtcttaggagcagggctggcatttgtttatagcagttttttggtaactccacaatatgactccactacccgtatctatgtagtgagtcaaaatgttgaagccggtgcgggcttgactaaccaagagttacaagcaggtacctatttggtaaaagactataaggaaattattctatcacaagatgtactgacgcaggtagctacagagttgaacttgaacgagaacttaaaagaaaaggtttcagtttctatccctgtcgatactcgtatcgtttctatctccgtgcgtgatgcggatccaaatgaagcggcacgtattgcaaatagtcttcgtacctttgcggcgcaaaagattgttgaggtcactaaggtaagcgatgtgacaacacttgaagaagcagtcccagcggaggaaccaaccactccaaatacaaaacgaaatatcatacttggtttattagctggtggtgtcttggcaacagctcttgtactggttatggaagttttggatgaccgtgtcaaacgccctcaggatattgaagaggtaatgggcttgaccttgcttggtgtagtaccagattcgaagaaattgaaataggagaacaatatggcaacgttagaaattgcacgtacgaaaaaagaattggtaaataagactgaagaatatctcaatgccatccgtaccaatattcagcttagcggagcggatattaaggttgtaggcattacctctgttcaatcgaatgaaggtaagagtacaactgcggctagtctcgctattgcctatgctcgttcaggttataagaccgttttggtggatgcagatatccgaaattcagtcatgtctggtttcttcaagccaattacaaagattacaggcttgacggattacctagcagggacaacagacttgtctcaaggattatgcgatacagatattccaaacttgaccgtcattgagtcaggaaaggtctcacctaaccctactgcccttttacaaagtaagaattttgaaaatttacttgcgactcttcgtcgctattatgattatgttatcgttgactgtccaccattaggactggtaattgatgcagctatcattgcacagaaatgtgatgcgatggtgctggtagcagaagcaggcaatgttaagcgctcgtctttgaaaaaagtaaaagagcagttggatcaaacaggcacaccgttcttaggcgttatcttgaacaaatatgatattgccactgagaagtatggtgagtacggaaattacggaaattacggcaaaaaagcctaatttctcagataacaataagtttgataagtaggtattagtatgattgatattcattcgcatatcatatttggtgtggatgacggccccaaaactattgaagagagcctaagtttgataggcgaagcttatcgtcaaggtgttcgctatatcgtagcgacatctcatagacgcaaagggatgtttgaaacaccagaaaaagtcatcatgactaactttcttcaacttaaagcagcagtagcagaagtttatcctgaaatacgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgacgctacttggactaactcccgtacttgctcatatagaacgatatgatgccctagcgtttcatgcagagagagtagaagagttagttgacaagggatgctatactcaggtaaatagtaatcatgtgctgaagcccgctttaattggtgatcgagcaaaagaatttaaaaaacgcgctcggtattttttagagcaggatttagtacactgtgttgctagtgatatgcataatttatctagtagacctccgtttatgagggaggcttataagttaataacagaggaatttggcaaagataaagcgaaagcgttgctgaaaaagaatccacttatgctattaaaaaaccaggcgatttgagggttggtttaaaactttagagtatcaactactttgttagatactgtgaagtaaaatggagagagtatgattaatataaatggttatcgccagttacggttggcgcttcttgaattaattgccgtattttttgctgtatttttaactagtcaatttccagattcggatcttaatcgaacaggcatcttatctattttcgtattacatttttttgcttttaatctttctaaaatgtacgtagatattgaaaaacgaggatatctatcagaagtagagaagacactagcctatagcttaattttggcattactattaacgtttacctcttttatgttggtagatgaggttgaaatttcaagaaggggattggtctatttttcggtaattaattttggtctagtttatttgtcgaattgtatcattagaaactataaacatatatttctaatttcaaaggagcaacaaaaaaatacactgcttataactacttatgaacgttttcgattgatgagaggcttatttgaatcagaattattacctgctaaatatttggctggagtcgtaattttaggagaaggtgtagctaacttggaattgccagcaccgcttattcctttggaacaagcagtagactttgcaactcatgaagtagttgaccatgtctttattaatcttccaagtgaaatttatgatttgaaaagccttgtatcagaatttgaaatcctaggtatagatgtgagtgtagatatcaattcatttgattttcaagctttacgaaataaaaaaattcaacaaattggtgaccatagtattgttactttttcttcgagtttttataagcctagccacatctttatgaaacgactgctggacatttgtggtgcaatagtaggtttaattttttgcggactcgcttcaattatattagtacctctcatccgaaaagatggtggaccagcggtttttgttcaaaaacgagtcggtaagaatgggcgaatttttaaattttacaagtttcgatcaatgtacattgatgctgaagaacgtaaaaaagaacttctgtcccagaatcaaatgcaaggtggcatgtttaagatggataacgatccaaggataactccgataggccagtttattcgtaaaacaagtctggatgaattgccacaattttataatgttttgatgggggatatgagtctagttggaacacgccctcctacagtagatgaatttgaaaaatatacaccgaatcaaaaaagacgccttagttttaaacccggtattacagggttatggcaggttagtggtcggagcaatattacagattttgatgaggttgtcaaacttgatgtagaatatattgacaattggacgatttggtcagacgtgaaaattttattgaagacagtgaaagttgttattaagagagaaggaagtaagtaaactttagctatgaaaatttgtttagtaggctcttctggggggcatttggcacacttaaatatgcttaaacctttttggagtaaacacgagcgtttttgggtaacttttgataaagaagatgcaagaagtattttaaagaatgaacaagtctttccatgttattttccgactaatagaaatgtcaaaaatttaattaagaatactttcttagcacttaaaattttaaaaaaagaaaaacctgatgttattatttcatcaggagcagcggtggcagttccatttttttaccttggtaaagtatttggagcaaaaacagtgtacatagaagtttttgatagaattgataaacctacagtaactggtaagttggtgtatccagtaacagataaatttattgttcagtgggaggaaatgaaaaaggtctatcctaaagctattaatctagggagtatattttaatgatttttgtgactgtgggaacccatgagcagccttttaatagacttattgaggaagttgaccgattaaaaaaagaaggcattattacagatgatgtttttatccaaacaggattttcaacttatgagcctcaatggtgtgactggaaaggtatcatctcttattctaatatggaagactatatgacaaatgcggacatcattgtcacacatggtggtccagcgacatttatgggtgcaattgctaatggtaagaaacctattgtcgttcctaggcaggagaagtttggggagcatgtaaatgatcatcaggtggagtttgctgaagttgttaagaatcgattagggacaatttttacagtaactgatattagtaaacttgaaacattgataacattgcctcaatctgattttgttgtggataactctacaaattacaatagtcattttgttgaatcatttacacgagaagttaccgaactattgaatggagctgaatgatgactttagaatcttggatattaaaaaaggtcctgtctcctaaaaaaatgaagttggatattaaagatgtacaaaaatatcaggttatttcatttgatgtttttgatacattattgaaaagagatgtgaagttaccaactgatatttttgatgtgatggcaaaggatattataaataaagaattagcagaaaattttaaggcattacggatacaagctgaaaaaaattctagaaaatatagtctgaaaaaggaaatatcattagaagaaatctatgaaaaattttctggaattacagaatccgagaggcaaaggctcattaagttagaaaaagagactgaatcccgttttttacacgctaatatagatgttttaaatatatataaagagtgtgttagacaaggaaaaaaagtttatgttatatcagatatgtatctacctactgattttatcgctgaagttttagccagggaaggcttttgtggatatactaaactgtttgtttcaagtgattataatgctgtaaagtcagatagtagcctatttgatattgtgagaaacgatcaaaatattgagatatcggattggattcacattggagattcctaccaatcagataaaaaagctgcagaggctatcggaataggaacattccaaataccaactgcctatagcaaattatacggaagagcagtggcgcagacagatgatttagaagataatatcttgttgaattttatcaacaatcgaattcctaataatagtagtgattattataagtttggctataattattttggtccctttctatggaaatatgttaactggctccacaaagaatttctgtcttatgatcccaaaaagatttttttcttttcgcgtgatgggctaattatgaaggaagcatatgagataattttcgcttcaaacttctccagtgactatcttgaagtttcacgtaaggcacttagaataccaattttatacatagataatgagcttagtacgataattgatatgttgccaccatctggctattttacacttgagatgctattggattgtgttggtattgaggagtcagagataagcacactattaacacagtataagtacgttgttaaccagaatttgactgctagagagatagttaaggatgaaaaattcaacaacttttatgatgagattagacctttaattattcaaaaatctaaatcgtcttatgaattattggcacgttatctatctgatcataaagtcgatggcaaatttgcgatagttgatatcggttggtcaggtggtatgcaacgctatcttattgaaacgcttgagaaactttcaatcaaaaatgaaattcaaggctattatacaggaatagttccttatgttaaaagaaatacgaaagtaattccaaacttaaagatgtcagggtatttatttgattttttgaatgatgcaaatgcagttgatataagaaagggctatgttggtctttttgaaacgtttttcttagaacaagatggttcagtaagtggatatacggaggattcaaacggtttggttaaagcgatgagagaatcctatgaatatcgagatagtgacggggagcctagtttcgagcttattgcagttcaggaaatccaaaaagcagcattggacttcatttctgatgttaatcgtgttgattatatcaaatcggatagctattcaaaattagctttattcaatgggatttattcagttgggaaaaccccttccaaaaaagaattgcaactttttggagatttccgcttttttgatgatggtattgaaaataaattagcaaatccaaggtcaataattcattacatttttaaaccaaaagattttaaaagtgatttaatgaagtcgagatggaaaattggttttttaaaaaaattatttaaagtaaatctttacaaaaaatagttatattgggtacaaaaagagggagactatggagcctaaaaaaatattgattattggtctaactgagagaataggtggtgttgaaacttttatttacaacacaactcgattttctgataaaagtaaatacagatatgaataccttattcatggtacagaggctccaatttatgaggaagaactgactaatttttatggtgaaaatccttttcattatgtaggtcattttaagaaaaaaacgatttcaacttttatccagttagcaaaattctatgcaaaaaataaaaatcattttgactatattcatttacaaacaggagcagcctctgaattgtcatatgttttcccttttagttcaatctataagattccattgatttcgcatagtcataatggaaatgggtactcgccattccttaatatgctttttaaaggcttactaaatttatgcacttcaaaaagattgtcttgctcagatgaagctacgaagtggttatttggtaaaaaatatattgggcgaacaagaatcattaataatggaattgatatcgatagatttacttttaaccaagagaaaaggtcaatcatcagaaatcagtataatattagtgatgaagatttcgtgataggtcacattggaaggttttcagaacagaaaaaccataaaaagatattatctatctttaataaggtaaaacaatcaaatccaaatgctaaattattactagtaggtactggggaattacaagatgaaataaaaggtagattgcctaaaagtttaggagattctgttatttttgccggaaagcaagaagaaacagaagcatactattctgcatttgatgttttcttgatgccatccctttatgaaggacttcctatagtaggtattgaagcacaatcaatgggattaccttgttttttctctgacaccattgatagtcagatttcattgactgataatgcttttatagtagatttagacgcatctgatgattactgggcagaaaagatattgtcaacaaaaatcaacaaagataggatgcaatatccaaaagagattaatagaaagtcattctctattcaaaaaacgataaaagatttagaggagatatacgaagtataatttatggataagataagtgtcattgtacctgtttataatgttgaaaaatatcttgaaagatgtattaattcattattagatcagacttactcaaatttagaaattattcttgttgatgatggttccactgatagaagtggacaaatttgtgatcagtataaaaatagggataattttgttgtaatacataaagaaaatgctggtctaggcatggctaggaacacaggtttagatgttgcaactgggaaatatattattttcgtagacagtgatgattatattgacgatgatatgattcaatcactttatgaagaaattcagaggacaggagcagatacctgtattggtggatttaaacgtgtttatgctaatcatactgatgttttaaaaactgaacttcctagaaaagaatatattggtaaagaagtttgtacagaattattaccaatgatgtttggaagagtggaaggcttacccagtgttgaaatgtctgtttggaaagtaatattttcaaatgatattatcaaaaagcatcgattaagattcccatctgagcgcgagtttatcagtgaagatataatatttgatactgaatactatcctctctctcaaaaggtttgtatcagtccaacagtaggctataattattgtgataatgaggattctttaactacacgttataataaagagcgttttaataaacaggtaattctgtataacgaacttgaaaaacgtgttactgaattaggaatccgagatttagcaattgaacgcatgtattcaacattggttgcaatagccagatatagtattaaattagaagtcaagttttctggacaaaatggtagagaagagtcatatacacatattcaaaatatatgcaataatgaaactttacaaactgtgttgtctgagcagaatcaatcaactgtaagattgcaatcgcgaatgatcaattatttgattagatataaaatgattaatttacttgtgtttgttatgatgattaaaaataagattggaatttgatgtataaaaatgaaaaaatatttattaatttttattgagtgtattaatcttcctcgatttctaatcctctatctatttattaatatatcaaattcaagaaacgatgttatcaaggatatggataggatttcgtataaatttattgaagtttcttgggaaaaattaagttattttaaaaaacttttgatttgcagtagcttagataaaatttttcgtaacataatctattatcgattgttgaaatacaacaaacaaagtgcgtatttgttcagggtcctttatagtatcaggaatgatatagaaatttggtcaattgataatataggaagtggtttaaccatttttcacggatatggaactattgttaattgccagtctgctggagacaatctttcggtttggcaaggtgtaacaattggaaaaaaaggaggagttgattcctcagaaaaacttccaactataggtaacaatgtacaaatatattcaaacgcagtagttgtcggagatatcacaattggagataatgtcagaattggagctaattgtgtggtgacgaaagatgtaccagctaaccatactgtttatggcaatccttgtaagtttgtaaggcaaaaataggatcatattatttgaaaggattaggcttagagaatagatggataatcagtttttttatgagtacactaaaattagaagacttaaactatggttaataaatgatcactggatttatatcaataaatacttgaagtatttaagaaaagaagaaaaatactataaaaagtctaactggtgttataagctactggaaatttattatgctagaaaaaaaaatatactggggagtaaattagggtttcttattcctccgaattctttaggtgagaatgtaacactttggcaccatggtagtataataatcaatggagatgctcaaattggagatggatgtatcttacacggcagtaactgtataggaaataatggaaaagatctaggtgcccctaagcttggaaataatgtagatgttggtttcggtgttgtaattattggtgatattttcattgctgataatgtaaaaatagcagctggagcagttgtaacgaagagttgttacactcaaggtgctactttagtcggagtgccagcaagagaaattgagtttaaaggttaagtttattgaatatgcagagattaaaaattacaattagcccattaggattactatatgttgcaatgattacgctcgccttatttcatcagtcaggactattttcattttattatttaacttcaattttagtttcccttttttggttaataatggggatgcttagttatttaattacaaagacaagaacaaaatcagagttatatgcgatagaaaagaaggtagcaagttatctccttattccttggattgctatgattatatataatgttattttatattctacaggaaatggagcagagcagtttataaaatccagttttgttcagataatgtttgctccgatcataataggaggagctgcgggctcatacattatttttggtaataaagtcattgaatatacaaaatatgcgatattaatatattatataaccgcgataccgattatgctttataatttaggagttgctaattttataaatggagtattgagtccttttactggtagcttagtaacaaatccttttgaacaaaattcagatttggtcttatctcttggtatattagttatttactattttgactatagtaaaggtatgaagaaaagtctatggttattaccgctaatgttacttatacttggtggtaaaagaattatgcttctatccttattgatactttgtggaataaaaatatatagctcgatgatgtcaataaagaataaagtacgattgcagtactttttatcgtttgttctccttgtagcaatgttcatctttgtttacttgatcaaaagtagtattttttctaattatgtttattctcatggtataaatacaatgggcagggtaaaaatgtgggattatgtagctcagtatgtggaattttcgccttcatatttggggtacggctacgctttttcaaatctattgttagaacaaaatcgtgtactaacatttggcaataaggtttatgtacttcatagtgacatattaaagatttattatgatttaggtttttggatttttacttattggggaatttataatttatttagactcccgcataaaattggaaaaaattataatcttaaaattgaaaatacagtatggctactcacaatctatttatttttactatactttacggataatgcattaacctattttacagtccagactttatatacttacactgttatcgatactatccgaaagtataatagagaatataactaatgtcttggtttggagttttatatgataataaaagatattatttttaatataactacttacattatagcaaaaatattttttagaaaaaaatattggttaatttctgaaagaggaatagatgctagagataatgggtattggttttttaaatatttaagagaacaacatccgcatattgatgcggtttatgttattgatactgatagtcctgattatgataaggttgcaattttggggaaaacagtaagaccaaatagctttttacacggtattttattttatgcttctgataaaataataggaacgcatccaggttgtggccagcctaaatggaaagcaatctataggcttgacaaattaggttttacgaatattaaagggaagcgtatttttttacaacatggaataataaaggataagattccaggtttaatgaaaggtgttttggaaactgatttatttatttgtggagcaaaacctgaatatcaatttgtattacaaaactttggtttttcaaataatgtaataaaatatactggattggctaggtatgataacttagagagcactttcgaagggactaggagtaataagatacttttaatgccaacttggcgacattatttatctggaatttcaaagaaggagtttttgcatagtgaatattatataaaatacaacgaaataataaattcgaaagatttggaaaaagtattgattgaccataatttcgagttaatattttatccacattatgaaattcaaaaaatgattggtgtttttaatgcttcgattagaaatgttacaatagcaaaatttgaagattatgatgttcaggatttattgaaaaatgcagatattcttgtgaccgactattcaagtgttttttttgatatggcatatatgtttaaggagacgatattctatcaatttgattatgaagaataccgtagggggcattatcaagaaggatattttgaatacgaagatagttttggaccagttgtgagaaattttgaacagttattacaagagttaattaaatttttagacatggggaccgaggagaaatatacacaaaacatgaaaaagtattttatatatagagataataataactgcaatagaatctattctgaaatagtgaaagttagatgacgggattctaaaaaatgaatagaaaatcgttaaaaaaaaatatgctattgaacactttacagaaggtactttcaatagtttttccgttaataactttcccatatatttctaggatattgaatattgctgatgttggaaaaattaattttactgcatctatagtatcgtactttgtcttattttctggtttagggatcgctaattatgcaacacgtgaaggagcaagaatcagagaaaatagagaaaaactaacactttattgttctgaattatttagtattaatctttttgctacagtaattgcctatataggcttaattatagtcattttactttcagataaaatttcgagctatggactccttataataatacaatcttttatgataattgggaatactttaggtgtattttggatttatgctatagaagaagagtactcttatattactattagaacaataatagtacagttagtttctgtctttttgatgtttggattagtcagagcagaagaagattatattatttatgcaatgataactgtttttgcgaatgttggagcaaacatatttagttttattcattctaggagatatgttcaactaaaattagtatttaataaaaatttacttcgtcatctcaagccgatacttgtaatttttgctacaactattgcaattacaatatatgttgaatcagacacgacattattaggtttattacagaatgattatagtgtgggtgtgtatagtagagcgaccaaagtttacacaataatcaaacagttggcttcagcagtagttatggttgcgttaccgaatctatcaagtataaatctaaaaagtgattttaatatttacgcaaataaggcaaattctatatttaaaacatcattactaattgttttaccattagggattggtttgttgttaacttcgagagaaattatatatttagttgcaggtcgttcatacattgatgcaataactccgttacaaacattaggcattgcaagtatttttgcaaatcttagtgcatacatgacatattgtattctcttacctctgaaattagaaaaagtccaattatttgcaacaatatttgcagcggttattaatgtgattttgaatctcattctgattccggtgtatagtcaggatggtgcagcctttacaactttagttgccgaagcatcggttttgataattgaaatagtctatctacttgtaatatataaaattaagttagatttttttaaattatcaagattagaaattttatcactgaccttaggggtattatggataattatcgtttgtacaataattactagttctacgagtgttatattaataggttttttgttaaaattcgttctctctacagtaggctacttttttattcagtatatgttatgttttcgtggaatttttcacagatccaattctgccaaatgaaaaaaattataactgagaagttttgttcttcttatcattaaactcttcatatcataggattttacaattttattgaggtattatttaaaagatgcaagtttccatgggtgtgattgttgttccatatgagtctttctaatgtgagtgtggttgcttttcattataggtcatatgggactttttgtatatactcaaaaaggctccataatctctatagtggatttacccactacagaaattatagagccagtatagcacagaggtgttttcttttaccttaaattggatttcatttgacaacaggaacccttgaaactgttttgtcagctaaaccaaggttactattagcattggctacttagtctaacagcttcaaacctgttatcaaatgaaattaccggcttactcaaagatagtgaaacaagtatttttgagcaaggcgaggtagctaactttattatagaactttcaaaatgtaatggagattgatttttcacaagtaattgtcataaaaatcagaaaatattttataaatatgataaaataaaagtgatactaatttgaggtaaggatatgaaattaagaagaagcgtagaaaaactaaagggaac

SEQ ID NO: 59 - DNA, 39719 bp, Streptococcus suis
cacggattaagtagtggcttcattttttgacaaaaaaatagctacttgttataatgatgacaattttatgaaataaggatattgagatgaatacagtattgtttcaagctcgggctaatcgcttgatagaagatgttttgaaagccttccaacttgacaagagagggacaatggatgagcttcgattggaaaaacatttacaagaaattttgcaggtgttgaatgagtcaacagatatcaatcggcttactattcgattggaaaaattttatcaaaatgcaagttttctgattggattgggcgacgttcaattaagcgaagcgactaagcgagcgtggcgtgcctatgatcaatttcactacgaccaagtaaaacccaaactactccttcacggaaatacgagactggggtaggttgttcgggatcataaagaaaaagagccgagtggctctttttatagtaattttttatagcaattttagataatcactctttttcgagaataaattggtgatttgaacagttaaattatttgcatcaatattatataagacaatgtaatctttctttaggggcattccacgagtgagaatacctgggcttatttgttttctaaatttaaagtggtcaaactcttcccctcaacccagatgactccttcacggacttacgagaatgggttggctgttctatcttgaatcgttaccaaagtcacaacccttggaaatcgaagggttgtcttttttatgctataattataggtagaaagaggtgtcatatgacctatatccaagtgaaaaatgaaggcaaattctatcaaatgggggaagccctgattattgctaataaagatgtaacttttgacattgagcaaggtgagctggtgattattctaggctcatcaggcgctggtaaatcaaccttgctgaatattctgggcggaatggatcaagcagatgaaggtgaagtgctgattgatggggtagatattgccaaattatcaagccatgaattgaccaattatcgcagagatgatgtgggctttgtcttccaattttataacctagtagccaatttaactgccaaggaaaatgtagaattggctgcggagattgtgaaagatgctcttgatgctgaagaagtcttggaacgggttggcttaggacatcggaaggacaatttccctgctcaattgtcaggaggggagcaacaacgtgtggccattgcgcgtgctgtagcaaagaaacccaaattactgctctgtgatgagccaacaggagccctggattatcagacaggaaaacaggtcttgcaaatccttcaagatatgtctcggaaagaaggtgcaacagtcattattgtgacgcacaatgcggcactcgctccaattgcagatcgagtgattcgtatgcgggatgcacgaatccattcaattgaaataaacccgagaccacaggacattagcagtctagagtattaggagagactatgaaaaagaccatctattggaaggacattcgacaatccatgttgtcctccaaagggcgatttttatctatttttagcttgatgatgttaggctcgctggcactgacaggattgaaggtaactgctccaaacatggagcgaactgcacaggcctacattgaagccaatcgaaccatggatttggctgttatgtccgaacttggcatcacccaagacgatgtcaaagagctacaaacgattgacaatgcaacagttgaggcagggtatttcaaggatgtagtcctggaagaagaccatcaggctgttcgagtgttttcaaaaccagaagagttatcccggtacaccttagtggagggaaattttccaacctctgaaaatcagatagccttatcaccctctcttcaagcaagctatcagattggagatacctttagcatcaaagaacctgacaaaaatggtacagtgctaaaagaaacaaggttcacagttgtaggttttgtagcttcttctgagatttgggacaatgtcaccatgggaatggctagtagtggtacaggacagctgacaggctatggggtcgtattgccatctgtcttccaatcagatgtctatatgattgtacggatttcctatgatgatttagtaagtctttcctatgccagtcaagcctatactgaaaagctggaggaccataaaaagcaactggaatcggttgtcgctgataatgatgaacagcgaattgccaacattcaagcagatggacaagaggaaatttcaaagggagagcaagaaattgccaaagcccaacaggaattagcagatgccgagaaggatatccaagaaggcaatgcccagctggcaacaggtcgggaagaatttgcgcgtggaagggctaaaatcatacagtctgaatccgagctgagattagcatacgcaactttacttgacacaaaatctcgcttggaggccagcaaacagcaattggatgaatccaagaaaaaattagatcaaactaaatccttcttggatgcgagcgcagctgaactctcacaatccgctcagcaattggaaacagcccaacaagaattagacaaacaaaatgcccaattaaatgatctaggcgccaccatttccttgggtagaaatgcatggtttcatgagcaaaatgaccttaatacccaagtagaaagccaagtgcaggaaggtgagactttatccgactatcctgaattgctggcgcgccaagaagccctagatgctgaaaatgcacgtttgaatcaattggaaaccgaatttgagcaagctcatgcaggctatcaagctggctttgacttgttacaatcgaaaaaagccgaatatcaagcaggacaaaagcaatatgaagcgtggaatgtggaataccaatcaggccttgcacagtataatgctgggttgacggaatacgaaaatggctacgcagcctatcaaaaaggtgttgctgattatgaatggggtgtccaacaattgcaatcctccagcctgaccctcaaccaagaggaacttagactcaatcaggcggacgaagcactaagcaaggcaagtcaagaattctccactcaaaaagcacaagctgaaaaagaaattacggcagctcagagcgaaattgaagacgctaagacagagttgagtaagattgaaaaatccagttatcaagtctatacacgctcgaccttgccgggcagtgatggctatgtaacctatcaaaatgccaccaaatccatcgcagcagttggaaatgtcttccctgtcgtcttatatctggttgctgccttggtgacctttaccacaatggcacgttttgtagatgaagaacgcacccagtctggattgtttaaagccttgggctataccaatcaacaaatcatggctaagtttgtcttgtacggactaggcgctgggcttgcagggactatcgttggcatcatcttgggaaatacagtcctatctccacttatctcttctatcatcactgagacaacggttataggcgcatccaccttgtatttctacccactgtggaccagtctagccatcggcttaacgctcttatccgcggtgctgcctgcctatctggtcgcgcaacgcgaactctttgaaaaaccagccagtctcctcttacccaaaccaccagtatcaggctcaaaaatccttctggagcgctggcgctttgtctggtctcgcctcagtttcacccacaaggtgacagctcgcaatatcttccgctacaaactgcggatgctgatgaccatctttggcgtggcggggacagttgcactcctatttggcggcttaggcatccgttcctctatctctggtgtcgtcgaccggcagtttggcgacctgatccattatgatatgttggtggtggaaaatagcaaagcttctgaggaagaactagatggattgtctgattttctacagtctaaccaagttcgacagtccttgcctgtggcatttgaacaaataacagaaaaaatcacctcaaatgaccaagaaaaaacagcatccatcagcctctatatcacggatagaccagatatgggacgtttgatagagcttgaaaccagtaaaggaaaagaactcactctaacaggacgaggcgtgattctgactgagaaactcgcacaattatatgatgttgccgttggtgataagcttaagttgaccctcaatgacaaagaagttgaagttcgagtagatggtattgctgacatgtatgctggacactttatttttatgacggatgaatactatcaggaggtgacgggtagcagaaaattagcaaatgcctacctagtcgaactcaaaaaggatagtgcccaacatgtccaagaagtatccagccaattattggatatgactgctgtcaaaagtctggtacagaatacctctctcatggctatgctaacgacaatggcagcctctcttcagagcgtcatgaccattttggtggtactgtccatcttactaggactagtaattctctacaatctgaccattatcaatatgtcagaacgaatccgagaattatccaccattcgcgtacttggatttcataataaagaagtaatcctctacatttatcgggaaaccatagccttgtccattatcgggattgtggctgggctaattggtggcttctatctccaccgcctcttactttacatgattggctctgatagcatccgcttcaatccagaagtaggagtagaagtctatctcatacctatcttagcgattgtgggcattctagccttccttggttggtatgtcaaccaccaactgagaaaggttgatatgctagaagcactgaaatccattgattagtgataaacagacaagtaccttaccgttcgcttcaaatggtgggtgcttgttgtttaaaattgtcaatttcctgtcattttaaacagaaatacgcaaacgttttaagaggctagttgttcccgttcgggaaaataaaaatgtagacgtattcatcaccaaaaaaactttgttttacttgaataataggccaaattagtgtaccattattctaatagactttttataatcgtatttaattgagctggtgaatttaggagtatttatggattcaagaagaactaaacgtagtaagaaaaaaccagttttgaccctattaaattggggtctttttgtagtgtacagcgtttccgctgtttttttagcctacagtatttatcggtaccagatttttaactttcgtaacctcaatcactttttagtaggggcaatggctgtcctaggagtggttggggttatcctgcttcttaggaaaaaggcaaaaaaatggacaaccgtcctcctcattattggtatcgccctttctggatttggtatctggggagtacaaagcttggtacaattgggctctacagtcaataaaaatgctagttactctagctatgatatggaaatcattgtaccagcagacagcacgattagtgatgtgagccaagtatcgagcttgcttgcccccgttgacaatgacagagacaatatcaccaagcttttggatagcttacagtcagaaaaaaacgttaccttgacaccaactccaacagcctcttatatggatgcttatcaagccatgatggctggccaaggagatgcaatggtcttgaacagtgtcttcttagaaatgcttcgtgcagaagatccagaggttgattcgaaaatcaaggtcttgtactctgtgaccaatgaaattaaaaacgaatcttcaagtacaaatcaagaaacgggtaatgccatcaatatctatatcagcggtattgatacttatgggtcaatctcatccgtatctcgctctgacgtcaatatcattatgaccattaatcgggataccaaaaagatattgctaacaacaacacctcgggatgcctatgttaccattccaggagctggtcaaaaccaaaaagataagcttacgcatgcagggatctatggtgtcaatacttccgtccaaaccttggaacaactctatggtatagacatccattactatgcccgtctcaactttacttccttcttgaagcttatcgacgttgtgggtggggttgatgtagaaaatacacaagaatttacaagtttgcatggaaaatattatttcccagtaggacaggtacatttagactctgatcaagctttgggatttgttcgagaacggtactcacttgccaatggggataatgaccgaggtaagaaccaagaaaaagtgattgcagccttgattaacaagctgacccagtctgaaaacctgcttcattatcaggaaattatgcaatcactttctgactctatccagactgatatgcagttggaaaccatgatggagttggtcaaccaacagttggaaacgggtggaaactttactgtaacttcacaagctgtaagtggaacaggaagtacaggagttctcccatcctatgccatgcctggatatgccctctacatgatggagctcaatccagatagcctggaacaagcaaaagcagcaatcaatgcgaccttagcaggtcaataaaacgatagaaatggaataattttggagcaatgatgaataaccaagaagcaaatacaattgaaattgatgtcttatcactattgagaacgatttggagaaagaaattcctgattctcttaacagctatattgacaactggcctagcatttgcctacagtgcatttttagtgactcctcagtatgattcaaccacacgtctctatgtagtcaatcaaagtagtgataacggagctggtatcaccaaccaagacttacaagcaggtagtttcttggtaaaagactataaggaaattatcctttctcaagatgttttgaaaaatgtgacaactactctcggactaacaggtggaatcaaggataagattacggtgacaattccaaccgatacccgtatcttgtccatcaccgtccgcgatagtgatccgaatcaagcagcaaccatcgctaatacacttcgtgatgaagcagctaaaaagattattgaggtgaccaaggtaagtgatgtgactactttggaagcagccctgccagcagaaaaaccatcgacaccgcaaacgaaacgtaaccttgtcttaggctttgttgcaggtgccttccttgcaactaccttggtgcttgtcctcgaagtgttggatgatcgtgtgaaacggccacaagatatcgaagaaagcttaggaatgaccttgctgggtgtggttccacaggcagagaaattgaaataggagagaaacatggctactttagaattagcaagtaataaacgtggattagtcaaaaagactgaggaatactttaacgccatccgaaccaatatccagttgagtggttcagaattaaaggtcatcgggataacttcagtcgagtcaaatgaaggaaagagtacgactgcagctagcctagcgattgcctatgctcgctcaggctataaaaccattttgttggacgctgatattcgtaattcagtcatgtctggtttcttcaagcccgcgacaaaaattacgggtctgacagactatctggcgggaacaactgacctgtcacagggcttatgtgatacagatgttccgaacttaacagtcatcgaatctggtaaggcttcaccgaatccaacagctttgttgcaaagcaaaaatttcgataatctcatcacaacgctccgtcgctattatgattatgtcattgtcgactgcccacctttgggattggtcattgatgcagccatcattgcacagaagtgtgatggtatggccgttgtcgcagaggcaggtcgtgtcaaacggtcaggggttaagaaagttgcagaacaactagagcaaactggtacgccattcttaggtgttatcttgaataaatatgatgtggctacggaaaaatatggagcctatggtaattacggtaactatgggaactacggtaaaaaagcttagtggtcatcggaaacaatttccaaatgtaggagcaacgaaatgatagacattcattcccatatcatatttggtgtagatgatgggccaaaaacacttgaggagagccttgcattaattgatgaggcacgtcggcagggtgttcggatgattgtagcgacgtctcaccgtcgaaaagggatgtttgaaacgcctgagaagatcatcatgtccaattatctagagctaaaaaaagtagtagccgaacggtttccagaattgaccctttgttatggtggtgaactctactacacaaaggatattataggtaaattggataccaagaaactaccaaccctgaatggtacgaaacaggtattggtagaatttagtatgaataccccttggaaggaaatccaagaggcagtcaatgaaatcatattgttaggattaactcctgtaattgctcatatcgagcgttacgacgccttggctttcaagggagaaagggtatccgaactcatcgataaggggtgctttactcaggtgaatagcaatcatgtcttaaaaccaagcctgattggagatgttgccaaaccctttaaaaaacgagtgcaatactttttagataatgatctggtcacctgtgtggcaagcgacatgcacaatctttccaaacgaaagccttatatgcaggaggccttcatacacattgaaaaagaatatggaagagatcgtgcacgggcattgtttaagaaaaatcccttgatgctactcaaaaattaggatattgggtttgttttacaaataattgtggagattatgaaaaatgagtaatgaattatatattgatagaaagttgagcagaaatgtaaaacgaatcattctccttgctatggatatgatattaattcttctatccatgattttaagtcgtgagtttttagatatcattgttgatattcccagcgagcaatttcacattgctgtcgtgttcgtacaaatagtatatgtagcgattgcaattcgattaaaagtattttctttgatcacacgctatactggcacacagacttatgtgaagattggcggaagtcttctatgtgcatatgttttcttgcttcttttttcgacatttatctggaaaaacttcagttatcgttttatcttggttgcatttattacctcttttgttgcactaattgtaccaagattaatatggaaatacatgcatgaacaaagtaaggtacagcaagcttcagagaatcaaccaattcgtacacttgtagtaggtgcaggtgacggtggaaatttattcatcaacactgtcgaagaaaagaaaatcaatattgacattgtcggtatcgttgatcaagatccaaataaattagggagttttatccgttcttacagggttctgggcaatcgaaacgacatacctcgtttagttgaggagctcaatgtcgaacaagtcactatcgccattccatccctgtctggccgtgatcgcgaagctattgtcgccatctgtaaatcagtcggagttccagtaaacaatatgccaagtattgaggatattttttctggagatgttacagtaagtgatttccaagaaatcgatatcgctgacttacttggacgaccggaagtggtattggatcagaaagaactcaatttgtactttgaaggaaaaacaatccttgtgacaggcgcaggtggttcaatcggatctgaaatctgtcgacaaatcgcacgattttcaccaaaacgattattgcttctcggacatggtgaaaactctatttatttgattcatagagagttgcaagaaaaatatggaaaatcgatagaattgattccagtcattgctgacattcaggatagggaacgcatttttgatattatggcaacttatcgtccgaatgtagtttaccatgctgcagctcataagcatgttccattgatggaatataatcctcatgaagctgtgaaaaataatatttttggtacaaaaaatgtggctgaggcagcaaaagcagccaatgtcgaaaagtttgttatgatttctacagataaggcagtcaatccaccaaacgtgatgggtgcgactaaacgtgttgcagagatgattgttacaggattgaacgagccagggaaaacacaatttgcagcagttcgatttgggaatgttcttggtagtcgtggtagcgtggtacctgttttcaaagaacaagttaaaaaaggtggacctgttactgttacggatttccgcatgactcgctactttatgactatacctgaggcaagtcgcttagtgattcaagcagggcatctggcaaaaggtggagaaatattcatcctagatatgggagaacctgttcaaattctcgaattggctcgtaaagtgatcctgctcagtggaagaaaagaagaggaaattgggattgtagaatcaggtattcgacctggagaaaaattatatgaagaattgctatcatctgaggaacgtgtcagtgagcaaattcatgagaaaatttttgtcggtcgagtaaccaataaagatcaagatagtgtacaagcttttatcaattctctcttgtcgatggatcgaaaagagttaaaggatgtcttgattgaatttgcaaaacaagaataaagaaagtaaaagtcattttactttcctagagtttaaaaggaattttaaattctgggaaggctaaatgtggataagaggtagatgatgctgagtcaacgcttaatagaagagaagagtataggtttcaagggtggaatctatcataaagttcaaattgagttggctaacaattccaatcatattgaaggtagtcaactttcccaagaacaaacgcggtatatctttgaaacaaacacaattggttttgagtaaggtgcgtctattagagttgacgacattatagaagtcagtaatcattttacagcccttgattaccttattgatggctttcaaaacgaattgaccgaggaatggatcaaggatgttcatactattttgaagtgtgggacatccgatgcaagaaaatcatggtttcaagtaggcaattataagtcattaccgaacgaggttggtggtgagcagacgagcttgcctgaaaatgtgactactgatatggcaagactcatcaaaaagtaccatagcttgcctctgatttcttttgaagatattcttgattttcatgttcaatttgagcgtatccacccttttcaagatgggaatggtagggtcgggcgtctaattatgtttaaggaatgtctgaaacacaaccatgttccatttattatcagcgacgatatgaagtatttttattatcgtggtctttcgaaatggggagaccaaaatgatttcttgcttgatacttgtctatctgctcaagatagatttaaaaactatttggaatattttaggattgaatattaaggagattatatgtatccaattttaaaaagagttattgatattgtcatttctggcctagccattatcgtattaagtccagttctattgctgattgcaatcgctatcaaacttgattcaaagggtcctgttttatttaaacaaaagcgggttggtaaaaacaaatcccacttcatgatttataagtttcgttcgatgtatgtggatgctccaagtgatatgccaacccacttattgaaagatccaacagcaatgattacaaaagttggcgcctttctcagaaaaacaagcttggacgaacttcctcaattatttaacatttttaagggagagatggcaattgttggtccgcgccctgccttatggaatcaatatgacttgattgaagaacgtgacaaatatggcgcaaataatattcgacctggattgacaggttgggcacaaatcaatggccgagatgaactcgaaattgatgaaaaatcaaaacttgatggttactatgtgaaaaatatgagttttggtttagatgtaaagtgcttctttggaacattcttaagtgttgctaagagcgaaggagttgtcgaaggcggaacaggacagagggatggtaaattttaaaatatgacaaagttagtagggaaaaaagttttatttttctccccagccttttttgggtatgaaaaaaaaatagtgaataaattgacggagctaggggcggaagttaagttttatgatgtaagatcagtacaaaattcgttttctagagcattactaaaagtatctccaaagatatttagcaatcagtctaaaaaatactatgataaaatattagatgaagaagaatctgaaaattttgactacatattaattgttaagtgtgatatgacccccatttcggcattaaaaagaatgagagatttatatcctaatgcaaaattaatattgtacttatgggattctatgaagaatattcctggcattgaacaaaaaatagtctattttgatcggctgttaacatttgatttagaagactctaaaaagaataagagttttctttttagaccgcttttttatgcggatgaatttatttctaaatcagtaagtaaatcatataagtatgatttagtttttttaggaacaattcattctgacagatacaatattataaaaaaaatagatagttttgctaaaaataataatcttaattctttttatttttgttatttacaaagtaaatttatttatttcttttataaaattgcaaagccagaattttttgatgccaaacaatcattttttgcttttgaaaagatgagtagtgaatcaatttctaaagttgttgaagaaagtaatataataattgatattgaacatccgaagcaaaatggacttacaatgagaacaattgaaatgattggtatgcaaaaaaaaatattaacaactaataaaagtattcaggaatatgacttttataatgaagaaaatatatatgttattgatcgaaatgtaagtaaattggatattaatttttttaatacaccttataaacctgttgattctgaagtttacgcaaaatatagcctaaagcagtggattatagatgtactaggagttggtaatgaacaataaatatacaatttcagaatttgtgagtactgggatttcttatatcttgacaaagctttttgatagaaatgcaagacttatcagaagaccagtatatatacgcggaaaaaaaaatttacaatataaaaaaggatttactacaggccatggttgtcgatttgatttaaaaggcgattcaatggctcggttaacttttggggaaaattgtgagcttggtgatgccgttcatattgttgctcacgataaagtaagtattgggaataatgttttaatggcatctaagatttttattagtgatactagtcatggagagtattctggggaacaacaagacagtccatttgtaagccctaatcagagaccattaagatcaagaccagtattcatcggtgataatgtttggattggagaaaatgttgttattttgcctggtgtaaaaattggatctggaagtataattggcgccaattcggtagttaatcaaaatattgctgaaaattcaattgcagtaggttcaccagctaaggttataaaaaaatatgataaaagtagtaatatgtgggaaaaaatagaggaacggtgatatgaaagttttagttactggtgcaaatggatatttgggcaaaggtgttgtaaaacaactacttgataatggtataaatgtgattgcaaccgattttcaagataattacattgacaagagagcagaaattaagtgcgcaaatctttttgaattagagaagccatttgatttttttggtaaacctgaaattgtacttcatatggcatggagagatgggtttgttcaccattctgaaaatcatttaattgatttaccaaaacactatgaatttctaaaaaaaatggtagaagatggtgtgaaacatgttgctgtattaggtagcatgcatgaagtgggtttctttgaagggtcaattaatgaaaatactccaacaaatccacaaagtttatatggaattagtaaaaatgccttgagaaatgcagtagagttgttgtgtaaaagtaaaaatgtagtatttcaatggttaagagggttttatattgttggaaatacaattgatggtagttcaatattttcaaaaatcgttcaagcaaatgagaatcatcaaaatcttttcccatttactatgggactaaatcaatttgattttatagactatgatgatttttgtaaaagtgtagctaagactgtaacccaagatagggttactggaataattaatatttgttctgggactcctgaaaaactagctgatagggtagaaagatttattaaagaaaataactttagtattcaattacaatatggagtgtttcctgacagaccatatgactcaaaagcagtttggggagatgcaagcaagctaagaatgattttagaataaggaaattaaaatgaaaaaagttttggttatctcggatgcgcatattgagaaattaccagataatacttattggtgtcgaacagcagttcatgggtatgacttttggactagatacttacgagtgtttgaaaaagtgatagtagttgctagggtgaaggcagtttcagagattgataagtctctttataatagagcagatggtgttggtgtcgaaattagagagttaccttttatccgtggtatgaaggggtatttgactaattattctgaaatgagtaagagtatctcaaagttaattggagatgaagattgtgcaatttttcggatgccatctatacctgcatttatgttgcttagacattataagagaactggaaaaccctacgcttttgaaattgttgcagatccaatggatgcatatagtgaaaataaagtagctcagtttatatttacgagactgttaaagcgagagacagtaaaagcaaatggtgtttcttatgtaaccaaatattttttacagggaagatatccatcatattcaattcttcacggtaaagattctgagcattttgacagttactactcttcaattaatttagataaatcttttttttcagagcctagaatatttaatgaaccactaagaacattaaatattattcatgttgctagtgcaataaattcggatataaaagggcatacaaccttattgaatgtcataaagaaacttcgtgaaaagaatttagatgttaaattaacatgtgttggtgatggtgataaaagagaatactatgaacaaatggctgttggccttggaatatcggatcatgtccgatttactgggttgttttcatctaaatcagacttaagaaatgaacttttaaaatcagatttatttttgtttccaacaaaagcagagggcttacctcgtgcagtaatagaagcaatggcggtctcgcttccatgtatttcaacaccagtaaatggtattcccgagttattaactgatgaatatctttttgatccgcttgatgttgaagggatagtaaacaaaataagtcaacttctgcgagcacctctcgaattgacagagatgagtaaaactaattatgggaaagctgaagaatatcttaatacaactttagaagttagacgtaatatgttttatagcaaattaaaaaattgtataaaaaaatgaaaaataataaaactcttttcttaatgggaaaaaactgtgatatgtatcggacattaaaagatactaacattaagttttctaaaatttattctgataaattatctaaatacttaattagaatatttagaaataatatgtatactcttcccttgactttagctgagtggaaaaaaaatattcatgaatatcagacaataatattatttgataccgaaagtactccttgcttaataaaatggttggccactcatgcgacaaaagaggcaaggttgatattttattatagaaattcaatcgaatcgttaaaagttaatagacaagctataatgcctgataaagtaaaaaaatatgggtttgaactttggtcttataatgttcatgattgtaataaatataacatgaattataatagtcaagttgctgattctagcgtttttcaacataataaagttttagatattaaatatgacgtattttttgcaggattagccaaaggaagaattcaacaattagatttaatacagtcaattattgttcaaaaaggcctgatcccatatttttttataccggataagagtgaatcaaagcaatcgcaacaattatcatatgataattatctagaaaaaataatgcagagtagggctctcttagattttgtgactgataaaaattatggcttaacaatgagaccactcgaagcaatgttttctaaaagaaaactaattacaaactacgatgcaataaaagagtatgatttttaccatcctaacaacattttcatatttaaagatgctaattgtttggataagattgaagagtttttagagttagagtatatagatttagatgaagaaattaataaaaaatacgatattgaaaaatgggtttatagatttttcaaataggttagaggatatagatggcggaacaaatttcgaatagtagaatcctaaaaaatacttttttttcaataggtgcacaaataatctccctattaactagcatcattgttaatctgatagttccaagatatatttcagaattaaattatgcttattggcaaacatatttgctatatgctagttatgtaggtatacttcattttgggattttagatggaatggttttacgatattcagaatttgactacaaagatgtaaataaatcaaatataagttttcatttttggtttttgaatttattattattgatttttacttcaatcgggatatttagtacttgttttttaaattcagatctttctaaaaaacaggttgtattaatttcgattagtatactatctaaaaatttattcatgttttcatcttattcttatcagatgacgaatagaataaaatcatatgcatggctaattatcagacaacggcttttatacggagtgtttgcaatatgtttattactttttaaggtagataactttgtattcttttgtatcgctgatattatagcagatttaacggggtttatttttagtttatggtctaacaaagaattttataaattatataaaatcaattcaaagcatgtcagtgatttattaaaaagtttaaaatctggtctaatgcttatgattgcaaatttctctagcaattttattgtaggaagtgcaaagtttgcaattcaaataatatggtcagcaattgtttttgcgcaaatttcgtttagttttagtattacaaatttatttttgacatttgtaatggcgataagcgcagtattatttccatctctgaaacgaatggataagtcgagattacctattttttattcagctatacggggcttgattactccagttctgatttgtgctttggcattttacttcccagggtcttatatattgaaaatttggttaccaaaatatgaagatagtttgatatatgctgggatattattaccattgataatatcatcaactaaggttagccttcttacaaataattatttaaaagcttttcgtgaagaaaaaaaaatgttaatcataaatgttatgagcatgctcatcgagctagcactgcttgtgtttttctctgtattgtacaaaagtttggaaggaatactaatatcaactgttctcgtgtctttagttagatcagttatttcagagtggcttgtttctagtcatataaatgtgaagtatacaattgaaaatataattgaatttttaattttaatttcttttattattattactatgaatttgaatgattcagtaggttttattgtatatagtggactattgttgttatatttatttattacatataattcaataaaaaagagtttagaaaatcttagaagaagaggaatttaggaaatatatttatggagagtattgcgattgtaattgtgacctatcgtccaacacaggaaattttgaaaaattttattgaaactaaagatttggctcagaaatatgggattagtaaatttttttgcgtggataattctctagaaaagactgaaataagcaatttgtttgcagagttatctgatattgaatacatttttaataataataacggaggactttctagggcattaaatattggatgtaatatggcaattagtaacgatgctgaatatgctgttctaatggaccaagatacaatatttccagaatcatttttttctgggattagagagtatctaaataatctcgaaaatggtgtaggtatattagctcccaatatgtacagattgattcgttccaattcgggtgacttagtattagatgaacgaccactttatggtaccgaaacgagtgaagttgaaatggttgtaacttcaggtagtgtaattgacttaagattatattccaaagttggtggctttgatgaaaagctttttattggtcatattgaccgagattattcctgtaaagtaattaatgctaagagaacaattttgcgtttgggcaatgtatttgtttatcaggagaatggatatgctaatgaaagtaataaaatatctatagggaatcggacattttatgcttcaaattattcatcggaacgatattattatgctatccgcaatgaattatatctcagacgcttgtgggggaataaatatactaaagaacaacgctcaccaattttgaagaatattatattacttctgcttttagaagatcataaattggataaattaaaagcaatgattagaggtgcctacgattctcgtagactttaagcagagctttagtttaatgtaaaaaagggagtaaagatggttttatttatttacgtatctctaattctcgcaaatttatttatcggtttaagacgttattttcatcctttcaataaatccaaaaatcgacttaatgtaataatttttatattgagttttattggtttttgcattttaatgattggatatagaaactttagcggtctttctaatgatcttttgaataaccaagcagagtataacagtttcctaaactatagagaatcaggatatgagataatttatagattgttaatgggacttggtcgaattaaccagcttgatttttatacttggagggcaatagttttatttgcaggattgttgctacacttcttttgtatttacaagtggcttccaaacccacatttatatttatcattttttagtatgttttatttaatccagggcgctgagttataccgaaattttgttgcctttgtcattttttttactggagggattatttatttatattcaaaggttaaacataaaaatattacatttggtatttttatattaattgctggttttattcattcttcttatttgctatactttattttcttaatatttaatagaaaagtatctcagaaaacaatcaatatgctaataagcatagttctccttctttgtgtgtttatttttataaatggtaacaaaattcctggattaacgcttatcacgagtttccttggggattctcgcttgatgaattatttcgatgctccaactaggtttggttttattattttctttttgctacatttttcatctctatttttatttagatatatggaaaaatacgggattaaaagtgaagcaattatgttggcaaaacagatgacattagtaacaatgttgtttttcccactttatatgattgacggtacttttataagaattggacgaaatttgttaccatttttatacggagttcaaggggagtactttcttgataagtcctcagatcgaaaaaaaataatttatcttgtgtttacatttttagcggtatctttttggatgtataatacattttttatttcctccagacctgaggtattgttttatccattttttactgataatatattttttaatccgcagttttagagaggtttttatctatgtccaaatataaaatgaaaaaaatatttattacaggtgcagctggttttattggcagtaatctggttattgaactattaaaaagtgatgatcattgtcatattattgggttggataatttgaataactattatgatgaattactcaagcattatcgtcttgaccagattaatcagttagccgaccaaagtgtgagtgattggacttttattaagggaaatttagcaaacaaagaattgattaattcaatatttgaacagtacaatcccgatattgttgttaatttagcagcacaagcaggtgtccgttattcgattacaaatccagacgtttatattgagagtaatattataggttttcaaaatattttagaagcttgtcgtcactatcctgttgagcatttagtgtacgcgtcatcgtcttctgtttatggaggaaatgaaaaagtaccattctctacggacgataaagttgataatccagtttcactatatgctgcaactaaaaagtcaaatgagttatttgctcatgcctatagtaaactatatgatataccaacaactggtttacgcttctttacagtttatggtcctgcaggacgaccagatatggcatactttggttttactaataaattgataaaaggtgaaacgattgaaatttttaattatggaaattgcaaacgtgactttacctatgtagatgatattgtagagggtgtaaaacgagtaatgtatggtgctcctcagaaaaaagttggatctgatggtttaccgataccaccatatgcaatctacaatataggtaatagtcaaccagaaaatttattggattttgttcaaattttgagtgaagaacttgttttagctgatgttttacctgaagattttgattttgaaactcataaaaaattagttccaatgcagccaggagatgttcctgtgacttttgctgatacatcagaacttgaacgtcaatttggtttcaagcctacaactactttgcgagaaggaattagaaaatttgcacagtggtataaaggttattatggttaaaaatttcgaaaagatctaccattttttcattgatatcagtttaatgtttaaatatatctttttatggtagttctttttattttattgtccaactaaatattttggtttcaagaaaactatacggaggactcttatatgaaaggtattattctggcaggtgggtctgggactcgtctctacccattgactcgcgcagcttctaagcagctgatgccgatttatgacaaaccaatgatttattacccattgtcaacactcatgttggctgggattaaagaaatcctaattatttctactcctcaggatctacctcgattcaaggatatgttgggtgatggttctgaattgggaatttctctctcttatgcagaacaaccaagtccagacggacttgcacaagccttcattatcggtgaagaattcatcggtgatgaccatgtggcgcttatcttaggggataacatttaccatggaaatggcttgactaagatgttgcaacgtgctgcaagcaaagataaaggggcaactgtcttcggttaccaagtaaaagacccagaacgctttggtgttgttgagtttgacgcagatatgaatgctatctctatcgaagaaaaaccagagaatccaaaatcaaattttgctgttacaggattgtatttctatgacaatgatgtcgttgagattgcgaaaaacatcgaaccatctcctcgtggtgaattggaaatcactgatgtaaacaaggcttacttagatcgcggtgatttgtctgtagagctcatgggacgtggttttgcatggttggacactggtacacatgaaagtctcttagaagcagctcaatacatcgaaacagttcaacgtttgcaaaacgttcaagtagcaaacttggaagaaattgcctaccgcatgggctacatcacaaaagaacaagtgtacgaattggcacagccactcaagaaaaacgaatacggacaatacttgctccgtttgattggagcagcttaatgacagaaaactttttcgataaaacactcgcagcccgtccagttgaaggcattccagggatgttagaatttgacattccagttcatggcgacaaccgtggctggttcaaggagaacttccaaaaggaaaaaatgttgccactcggcttcccagaaagcttttttgcagaaggaaaattacaaaataacgtttccttctcccgcaaaaacgttcttcgtggtcttcacgcagagccttgggataaatacatctctgtggcggacggtggtaaggttctgggaacttgggtcgatttacgtgaaggcgaaaccttcggtaatacctaccaaaccgttatcgatgcttcaaaaggtatcttcgttccgcgcggagtagccaatggtttccaagtcttgtcagatttcgtggcatacagctacttagtcaacgactactgggctttggaactcaagcctaagtatgcctttgtcaactacgcagaccctagtctcgacatcaagtgggaaaacctagaagaagcagaagtctcagaagcagatgaaaatcacccattcctcaaggacgtcaagcctttgagaaaagaggacctctaatgtttgaagcctttttggaaatagcagagcagttaaacaagttaggaatcactcccttgttaatgggatcagttggtttggaaaggcggacaggacgagattggcaggcaagggaccttgatattcatgtgcccagtgatccacggggatgggaagcgccagacgatgaacggatttatcaggcggacgccttgatttctatgatgaaccaactaggctatgtcctggttgaccgtcacgaacatgaatttcataaagacggcttatctattgaatttggaggcctacattcactgcctgaatttgctggtgtagagctagaagatttggaagaactagaaacagcaggtgttcgctattacctaccgacacttgaacaatacctgaaaatctaccaagcctcttcaaaagattcctaccgagcagaaaataacaatcaaaaagactttgctaagattgcttacttgaaagaagtattgaagtagtctggtaatgcaagagggcgagcaaagcgagccaatagcgatagtttccgccgtagtgaaaatacataatcttgcaggggaaatttcgaaaccttaggtccaaaatttagccatgaaaccgaaggtttgctggtgtccccactacctaaggaaactatcaacaaaagaaaaaacttttcggagaaaaaaatgtctcaatttaaaaatattatcgtaactggtggagctggttttatcggttcaaactttgtacactatgtttataacaatcatccagatgttcacgtaactgttttggataaacttacttatgcaggaaacaaggcgaacttggaagctattcttggtgaccgtgttgagcttgtagttggcgacattgctgatgctgagttggttgacaaattggctgctaaggcagatgccattgttcactatgcggcagaaagccacaacgacaactctctcaacgatccaagcccattcatccatacaaactttatcggtacttatactcttcttgaagcggctcgtaaatacgacatccgtttccaccatgtatcgactgatgaagtatatggcgatcttccattgcgtgaagacttacctggtcatggtgaaggtccaggtgagaaattcacatcagaaacaaaatacaacccttcatctccttattcatcaaccaaggctgcatctgacttgattgttaaagcatgggttcgttcatttggtgttaaagcaacgatttccaactgttcaaacaactacggtccataccaacacatcgagaaatttatcccacgccaaatcaccaatatcttggcaggtatcaagccaaaactttacggtgaaggtaaaaacgtccgtgactggattcataccaacgaccactcgactggtgtttgggctatcttaacgaaaggccgcatgggtgaaacatacctaatcggtgctgacggtgagaagaacaacaaagaagtgcttgaattgattcttgaaaaaatgggtcaaccaaaagatgcttacgaccacgtgactgaccgtgcaggacacgatttgcgctatgctattgatgcaagcaaacttcgtgacgagctaggatggacaccacaatttacagacttctctcaaggattggaagaaacaatccagtggtatactgacaaccaagactggtggaaggctgaaaaagaggctgtagaagctaactacgcgaagacacaagaagtgcttaaataagaaatggaaggctgggcttttgtccaagcctttcttaaaaaagaatgttgtaaatgataacaaaaaacattctgttttccttgatatagaaactcttgttataaataaaaacaaatggtatactatacttataaaatttttgaggtatatataatgggagaatcacttttttcacaatctacgcttgctaagatcgtattggatggacgaaaacacaatagttggtctcagcaagaactagctgataagactggaatcaaccgcgccatgattagtcgaatcgaacaaggagattatattccatctatttctcaactagaaagtttagcagaaactttggaatttgatccggcttcattatttgtaagtaagagcgaaactgcttcagattcgaaggtcgcaaagacaaatatcgctgttgcaggtaccggctatgttggtttgtccaatgctgttttactggctcaacatcatcatgtagttgccgttgatgtaattcctgaaaaggttgagttaatcaacgcaagaaaatctccgattcaagatgattatattgaacaatacctagctgaaaaagatttggatttggtcgcaaccttagatggggaaaaagcatatgaagaagctgaaattgtcatcattgctgcaccaacaaactatgacagttcaaaaaattattttgatacaggacatgttgaaacagtgattgaaactgtcttgaaagtgaatccagatgccttgatggtcattaagtcaacgattcctgtaggctttacgcaagcagctcgtcaaaaattcggtactaataatatcattttcagtccagagtttttgagagaatccaaagccttgtatgacaatctctatccttcacggattattgtttcatatgagaaagatgacagcgaagctgtgattgctggtgcagaaaaatttgctgctttgctacaagagggggctttgaaatctgaaattgaagcgcttcatatgggatcaacagaagcagaagcagtgaaattatttgcaaatacctatttagctcttcgtgtttcctatttcaatgaattggacacctatgctgagttgaaaggacttgatacggaatccattatacgtggggttggtttggatcctcgtattggtgaacattataataatccttcctttggttacggtggctattgtttaccaaaagatactaagcaattgttggctaactatgataatgtacctcaaaatatgatgacagccattgtcgattccaataagacacgtaaagactttattgctgatcaggtactgaaaatggcaggctattacgattactctacgcatgatcaattctctcaaacagttgagaaagatgttgtgattggtatctaccgtcttacaatgaagagtaattcggacaatttccgtcaaagctctatccaaggtgtcatgaaacgtctgaaagccaaaggtgccaaagtcattatctttgaacctaccttggagaatggatcaacctttttcggttcaaaagtcgtaaataacttgaaacaatttaaagcagattgtcaagcaatcgtcgcaaaccgatatgacagcgttctagatgatgtacaagaaaaagtctatacacgcgatattttcagacgggattaatgaaaaactagaattctagtctttatgattaggattctatttttttatgttcatacctattcgaaggacaaaattattttatacaatatttttatgagtgaagtagcatgttgacgaataggtgtgcatttgtaggttagagaagttaaatgtagtattttttgtctacagtcctcactatggtataatcttcatatgaaaaagattagtgatttaggtttaacgggtcgaaagctggttggtgaggggctgattcttgtcatcataggtattggctttctgattgctggctggcaatttccagggttgattttgcgttttattcacgctgggttattcttcttagctctttatgaattgagcatgattttcttcagaaagaagaagtcaaatgaaagtattttagccttggtgggcaaggctgttttgtttggtattctagctagtattgacttggccattcagattccactatattttgcggcgatatttattggtatgtaccagctgtttacagcggtgattaattttatcacattttacttatataaaaaagatgatgtgcagccgagaattcgttttttaatggatgggatttggttatctgtcttggggatagcttccctttttgtatctggtacacaattggttgtacagaccttggtcattggtgtttatttgatcctctatggtatgactaatttgcgggatggtttattgtttgaagaagcagtcgagcagcaacgtcccaagcgtcatcttcgtgtgacccttcccttatttatcgctgccctagtcccaaggttgaccctgcaaagagtcaatgactttttggcagataacaaaggagagacacctcagtctatctacaacacccataaagagtgggtgggtaatccctccctggaggtgtttgtacatgtcggtgaggaaggatttggagcagtaggacatattgatttgagttataagggtcgtgtttatggctacggttcctatgatgtcctctcagagcgcatgggaggtgcaattggcgatggtgttttgtttaaggcagagcgcaatgcttatatccgtttttgtactcaagaaggaatgaccatgcttggttaccaattagccttgaatgctgaacaagaaaaagcggttgaagaaaggttggctgagattgataaattattgattccttggaatcctagtgcagagaaggtagcaactacagcagatggtcaaccaactgaaatgtacgcctaccgtatcaaaaaaatcattggcgctcaattgttcaaatttaaaaaatcgaaattcaaaacctattttgtcctatctaccaactgtgtcctcttggcagactcagtcattggacaagcgggcacggatatccttggcattcgagggtttatagcccctgggacctatcaaacctatctggatcaagaatatgaaaaaccacatagtatggttgttgcaaagaatatttattatcgcaaagaaaaatcctagtttttgctaggattttctatttgatcaggcatcctccaagctaaaaatagcaatatatttacgtactaaaatttgtccaaaaatatttttgtgttataatgaaaacaagtacgagtaattttctatgtttggaggaaatatcaaatcactacttcataaacatgatttgacattacctgaatttacgaaaatgtttggaatttcacgcaatagtctgagtcgttaggaaaatggcaccagtacagtttccacagaattcattgaacgtatttctcaacaatttaacgtttcttatgtctgttttgtcggggaggataagatgctaacacctgtagaagactatcaactaaccttaaacgtagaagtgataaaagaacgtggagcagccattttatcacagctttatagataccaagataatcaagatattgcttttgatgatgagtccaacctatggattcttatgagtggtgatttggccgaattgatcaatacgaaaatataccttgtcaatactttcgatgaaatagagcgttacaatggctatttagacggaattgagcggatattgaatatggtgtcatcgggtggtgactcaatgtgaatagagaaatttagtggagctgagtttcagaaggtcttcagcgaacgtatcgaacctaacttgtggatagatggtagcaactggataatgaacttagcacgcaaggccattaaattacattcggaaaatttctccaccacatttgatactatttagggataatttttttataaatttgtgatttatttgaacgattagaaatctttaaagaacattataagtatgattcacatgaggttccggaagttcatcaatgcaatgaatgggaattttataatcgatcattatatatgagagctcaatcatatttccgaagatgatctttacctttttggttgagcaaaaaaagaatgacctaagtcgagaatggtgcaatgcctccacagttgatattatcaaggagcgtataaaacaatcagatgtttttgtattataattttcaggagaaactttgaattcccaatggtgtacttgggaattgggatatgctgacgcattagggaagaagatatgtgtttacttctcagaagaaataaatagaaaaggtattccaaaattctatgtagcttatcctgaattgcaaatgtcaaaaaatatatatgtcaaaattaaagggaacgaagatattttacttgaagagtgaaaaaaattataggcttataataaattagaaatgagggtaatatgagacaagaagtatttataaaaaaattttcgaaagctatacaagaaggaaatgcagcagtgtttgctggtgcaggaacatcggtagatgcaggttttgttaattggaaagaattagtgagatcgttctcggaagagattgaattggatgttgataaagagacagatctaattggaataactcaatattatataaactccaaatctggaaatagaggctctttaaatcaagaaatagttgatcaattctctagtcgagaagcagagacggaagtaatgaatttattaacaagacttccgatttctacatattggacaacaaactatgataaagttattgaaaatggtttaaagaaaaataatcgtagaggagatattaagaaaaaaatacaagatttatcagttagtatatcagacagtgatgcaatagtttacaaaatgcatggtgatgttgagtcgccaaatgatgccgttatttcaaaagatgactatgaaaggtatagtgataaaaactcactgtttgtaacagctttgcgtggtgatttagtctctaaaacgtttttgttcgtaggttttagttttgaagatccaaatttggagtctatactaggaaaggtgaatattttattaggagacaataagcgagaacattattgtattcaaaagcaagtatcagagaatgagtatgagagaaaagaagaatatgattatgctaagattaaacaagatttaaaaattaaagatttacaacggtatggtatagagactgttttagtcaatgattatcctgaaatacttaaactaatatcaaaaattgaggaagagtatttaaaaaatacaatttttatttcgggtagtatttccgattataatgacaattggagtcaagaaaaggtaaaacaattctgctacaatttatcatattcccttgtttcaaaaaattataaaattatatcaggatttggagtagggatcggtagtagtgttattaatggagctcttgatgaaatttataaaaccaaatatagacatgtcagtgagcatcttaggttatttccttttcctcaacatgatgatggagaaaagtccttagttgaacgttggactgagaatcgtgaacaaatgattagtgaggtgggggtctgtatatttatatttggtaataaattagataatggtgaggtagtaattgcaaatggaatgctggaggaattccagattgccaaagaaagaggaaaaataataattccaattggttctacggggtttgcagcaaaagaaatttttgatgaaatgaaagtgtcgggggactatccatatctaaatgattattgggagattttagagaccgaagaagatgttataaaagttgttaatacaataaatgaaattattgaaggagttagataatggcaacaaaagtatttatttcctttcgttttagtgatggaaaagagattaaagatgaactagttgatttatttaatgaatctactgaggttattaattggtctgaggatacagatagaagtcaaatgagtgacgatactattcaggagtatctatatgagagattaaaagatacctcagttacaatagtgttgttaacaccaaaagcagtggattatagcaaaaacttgtggggggaatacgatgactggctttatgatgaacttagatattctttagaagatagaatgaacaacagaacaaatggagtagtagctgtatataccaatgatgctaaggacaaattaatttcggaaagcactcatagttgttctcaatgtcaagagactcaatcgtgtagaagtttgaaaaattttgataatttagttcgaaaaaatatggtaaatataaagaacagctataagaaaaatccatgtgacaatctctatgatgccgaacatgactcttacatttctttagtaagtttagaggagtttaaacaagactatactaaatatattgataatgcaaaagaaaaaagagatagactacatgaatttgagataagtaaacgaatgtgaagaacaatgatttagtataatttgtcataaaaaaatagtgataataattatttgaggctgagcaaaaagcccggggccacttcacagagttcgtgtcaaaatctcagcgcagtggttgattggctttaacagtccagtggactgttaaaggttggagataggatttgtgaaacaaatctctgcaattagcgttttacattccaaatctgaccattacgactgttgcgaacaaagttcgctttatctccaacctcaaactgtctcccagacagtttgaggtgtgcgggggtgggagtgaaacagtctggggatagactgtttcagttcaacaacttaaaacgaaaaattgttgacgaactctttttgacctagttgagttcttttcaactcttcaatttttcagtcaataaagctctctaatcgttgatatgacagcgtttttggagttttttctgctttttaactgataaactttgaaaaatcctagtttttgctaggtttttctatttgatcaggcatcctcataccgcaaaatccctgatttcatgctataatagttctatggataaaaacaagttattattaattgatggctcttctgtagcctttcgtgctttctttgcactctatcatcaaatcgatcggtttaagagtccgactggtcttcataccaacgccatttatggtttcaacctgatgttggatcacatgatgaagcggattgagccgactcacattttagtggcatttgatgcagggaagacaactttccgaacagagatgtttgcggactataaggcaggtcgtgccaaaactccagatgagttccgtgagcaatttccctttattcgtcagatgctggatgccatggggattaagcactatgagctgaaccagtacgaagccgacgatattatcggtactttggataaaatggcagagcggacagacattcctttcgatgtgaccattgtcagcggtgataaagacttgattcagctgacggatgaaaacaccgttgtggaaatttccaagaaaggggttgctgagttcgaagaatttacccctgcctacctcatggaaaaaatgggcatcacgccaacacagtttattgacctcaaagccctcatgggagataagtccgataacatccctggggtgaccaaaatcggtgaaaagacaggtctgaagcttctaaccgagtttggttccttggaaggaatttatgaacatatcgatagtatgaaggcttctaagatgaaagaaaacctgattgcggataaggaacaggcctttctttctcgaactctagcgaccatcgatacgcaggcaccgattgaaattggtttggatgatattgtataccaaggtccacggattgaggagttgggtcagttttatgatgatatgggcttcaaacagttacgggcccagctaggcacgacgaactcgcaagaggaagaagtactggcctttcatatcgtatccgaagtcagctctgctatgttcaaaaaagaccaattcttttactttgaaatcttgggggagaattaccaccgagaagaggtagttggtctggcttggggggacaaggatggtatctatgttggtggtcctgagctcttggatagtccggtattgaaggattttctggaacaccagcctatcaagacctatgatttcaagcgtggcaaggttttgcttgctcgtaaagggattgatttaccctctgcaacctttgatagccgactcgccaagtatttgctttcgacagttgacgacaatgcgctgacaaccatcgcccatctctatggtcaaaccagcttgattcctgacgaggccatttacggcaaaggtgcgaaattggctctgcctgagcgtgatgtattcttcccacatttggcccgcaaggtgcaggtcttgatggagacagaggcaccgatgttggccaagttagaggaacaccagcagtccgatcttctctttgagatggagttgccgcttgctaatgtcttagccaagatggaaattgctggaatcaaggtaaaagtagagaccttaaaagccatgcaggctgaaaatgaagtcttaattgagcagttgaccaaggaaatctatgagttggctggtcaagaatttaatatcaattcgccaaagcaattagggactattctctttgaggatatgggcttgcccttggaatacaccaagaaaaccaagacaggctattctaccgcggtggatgtcttggaacggttggcgccaatcgctccagttgtttcaaaaattttggactatcgtcagatttccaagcttcagtctacctatgttatcggcttacaggatgccattttagaagatggtaagatccatactcgctacgtgcaggatttgacgcagacaggtcgtctctcatcgacggatccgaacctgcaaaatattcctgttcgtcttgaacaaggtcgtttgattcgtaaggcgtttgttccttcgcttgaaaatagtgtccttctggcatcggactattcacagattgaattgcgtgtattggcacatatttctcaagaccaacacttgattgaagcctttcaacagggtgctgacattcatacgtcaacagccatgcgtgtttttgggattgaaaaggcagaggatgtgacgccaaatgaccgtcggaatgccaaggccgtcaactttggtgtggtctatggaatttctgatttcggtctttccaacaaccttggaatttcccgtaaagaagcgaaaaactatatcgatacctattttgaacgtttccctggtatcaaaaactacatggaaaccattgtgcgtgaagcacgtgataagggctacgtagaaacgctctacaagcgtcgtcgggaattgccagatatcaattctcggaatttcaatgtccgtaatttcgcggagcggacggccatcaactcaccgattcagggttcggccgcagacattctcaaagtagccatgatcaatcttgatgaggcactgacagatgctggtctttcgactcgtatgctcttgcaggtacacgatgagattgtcttagaagtgccaatggcagagctggaaacagtaaaagctatggtcaaggagaccatggagtcggccattcagttgtcagtcccattgattgcggatgaaaatgaaggtgagacttggtacgaagccaaataagctaaaggaagtaaatcgatgaagaaatcacttgtactgatgggattactgagtttgtttctcactgcatgtggtggtaaggaacaaacgagttcaagtcaacagtcgagttcatcaggagaagaattctcagccaccttgcctattttacaggagaaagaagatacaagtaacgaaaagttagatgtcttggccaatgcagaaaccattgtcgtcaactcaaatcctccagcggatgagacgcaaaaaggccacaagattcatgcggccaacaatggtgtagctgaacaggatgaaaatggaaatattaaagagtattttcgttattacgatgttccatcaacatggacgattaatgtggaaaacaccgaagatgagactctgatggctgtctatgatgtgaaagaaggtgccagtacctttatggttcagctctataatatcaacgccttcaaccaatctccattagaagatggccgcaatatgacgatggacgagctggccgaacgcatgaaagagaccaatcacgatttttcagaagatatggttgtgacgattgctgggcaagagtggcaggttggacgccagattctcagtgaccaaaaattggctcgtttaactttctaccgtatggaatctactggttcttatgatgattctgttgtggttggtgcaatatattattcgctggatcctggacttgatacggatcgcactttgttgaaaaaagctataggtcaattgaaggatgttgtttaccaaatatctaaaaagtagcatttattgtttcaatacccaaggccattccattaaaggagaattacatgacgtacgcatttgaaaatcctagtcaggatactattttcaactatcttaaagaagctaaaactatcgcggttgttggtttatccaatcgggaagaaacagcagcctatcgggtttctaggatcatgcaggacgctgggtatcggattgttccagtaaatccacggtctgctggagaaacaattcttggtgagactgtctatgcaagtctcaaagatattccagtttccatcgatattgtcaatgtctttagacgaagtgaatttctccctgacgttgctcgtgaattcattgaaacagatgctaagattttctgggctcaactcggtttggaaagtcaagaagctgaggaaatccttcgtcaggcaggtcgcaatgatattgtcatgaatcgctgtattaagattgaataccaaaagatgattggagaataaattctttattgagcaccagtttcggtgattaaaaataaaagctatagaatctttgcaaaacccttttaaggggaagaggccagttctatagcttttttactttttcattgcaaaaaaccgagcacgcttggctcggttagtggtttatgattgtcagatgcttttagttgattgctgcaagaagggcatctgcttgttttgcaagttgagcttcatcaacaggtgcaccaattgttgcaagagtgaattcatcaaccaaagaagtacggataaatggaagtagtttgcggtattcaacagctgcttcgtcttggtgtgcaaatgatgagatagatacagtaacaactttttcgttgattgctgaaacaccacgtgtgtcagaaagatcgagtgcacggctaagccagtcaagaaggtttcttactgaacctggaatgccagcgttgtatactggtgagaaaatccagatagcatcagcagccaatactgctgcacgagctgctctaacagctgcaggtgcatcagcttcaagatcttgtgagaatacaggaacatctttccaatctaagtaagaaacagttgcttttccttcaagtgctttttcagcagattttgccaattcagcagagaatgcaccctcacgaagagaaccaactaaaaataatacgtttgccatagtgataatagctccttaaaataatttgatgttattagtatactctttttatcactagttagcaatagttttgaacttaatttttaaattttttcaaaatctcagctagctgatcttgttcttcttgactgagtacagaaaagagttcgccgacatgtgcataatgatcaggtaggattttctcaatggtttctcgtccataaggtgtcagaccaattcgaaaggctcttctatccttgcagtcaatggttttggaaatgtagccttctcgaatcatatttttgatgaccactgtcatgtttcctgatgtgctcagcaatttatcgattaggtcctgaattctcaagttgcccttgttgtagagtgcctccaatactccaaattgggcaacggtcagtccatattttctgatggtttccatttctttttttgaaatagtatttgctgctcttcgaaaaacgacaaggctgtgtaaggcatgtttgttttcgtttaatgatttttctacgctattcatacgaatattttagcaatatttacattgattggcaagtgatttcctaaaaaataggaaggtatacttgaatattttttgtaaaatttccgtttgattttctagaaaaaatagcattgcagggggatttgtagtataatagggatactatggaaaaaaaattcagccgtctcttggcatttgctagtggccgtttgggtcaatgtcttattggtttttttgttcttgcattcagtgttatctttttaatcctctacgtttgggaacagtcttctcgtccttttgaggaggctagagttggggcgcaacagattgcacagcaatatgcggatgtgagtcaggtggatgactttgcaatctataatggtacggaaacttattatagcttgaaaggtaaggataagaacggagatgaggtatacgtgttgataccaagtgcttcgtcctctatttatgtctatccagttggggcagggattacaaaggaagaagcgcaagcgattgctcaggagaatggtgcaaaaacggctgatcgaaccattctaggctatagggatggcaaaccgatttgggaagtcaaatcggggacagcctattatttggtggattttgaaacaggtgactttgtcaagatggagggattatgagcaagttatcaagacgtgtcttagagatggaagaaagtgtgaccttggctgctggtgcgcgtgcgaaagcactcaaggctgagggccgcgatattttagaactaacgctgggggaaccagattttgttactcctaaaaatattcaagaagcagctattcaagccatcgaaaatggcaaggctagtttttatacagtagcttctggtcttccagagttgaaagatgcggtaaatacttactttgagaagttctatggatactctattcaacgcaatcaagtagtagtgggtacgggtgccaagtttattctctatgctttctttgcggcggtcatcaatccaggtgacgaggtcctcataccaacaccttactgggtttcatatgcagaccaaatcaagatgaatgaaggggtgccagtctttgtgacagcgacggaagagcatcatttcaaggttacagttgaacagttagaagcagctcggactgacaagaccaaggtcctcttgctcaatagtccatccaatcctacaggtatgatttatagtcgcgaagaattggaagctattggtaattgggctgtagaacatgatttgttgattttggcggatgatatttacggtcgattggtatacaacggtaatacctttacacctatttctagtatttcagagagcattcgtcaacagaccattgtcatcaatggtgtcgcaaaagcctatgccatgacggggtggcgggttggttacgcagtaggtaatccagaaattatcgcggctatgggtaaaattatcggtcaaacgacttcaaacctgactaccgttgcccaatatgcggccattgaagcctttactggcccccaagatacggtagaaaccatgcgtcaagcttttgaagaacgactcaataccatctatcctttgcttgcagaggtgcctggatttgaagtagtcaaacctgaaggagccttttatctcttcccaaatgtgaaaaaagctatggaaatgaaaggctttacagacgtaacggagtttacgacagccattttggaagaagtcggtgtggctttggtaactggtgcaggtttcggtgctcctgagaatattcgtctcagctatgcgacagatatggatacgcttaaggaagcggtcgctcgtttacatacatttatgaaaaaataaaaagaggaaatagaatgtctagaaaattgattacgattaaccaagtgaaagattacgtgggtcaggaagtgaccatcggtgcctgggttgccaacaaatcaggtaaagggaaattggccttcttacaattacgtgatggaacagctttcttccaagcagttgctttcaagccaaacttcattgaaaaattcggtgaagaagctggtactgagaagttcgatgtagcgaaacggttgagccaagaaacttctgtatatgtgacagggattgtgaaggaagacgaacgttctaagtttggttatgagttggatgtgacagaccttgaagtgatcggtgagtcacaagattatccaattacgcctaaagaacatggtacagacttccttatggataaccgtcacctttggttgcgttctcgtaaacaagttgccatccaacaaattcgtaatgccatcatctatgcaacctatgaattctttgaaaaaaatggctttatcaagtttgatagcccaatcttgtcaggaaatgcggcagaagattcgacagaattgtttgaaacagattactttggtcaacctgcttacttgagccaatcaggtcagctttaccttgaagctggtgccatggctctcggtcgtgtcttcgactttggtcctgttttccgtgcggaaaaatcaaaaacccgtcgtcacttgacagaattttggatgatggatgcggaatactcattcctcagccatgaagagtcacttgacttgcaagaagcttatgtcaaagctttgattcagggtgccatcgatcgtgctcctcaagccttggagactcttgagcgtgatgtagatgcccttaaacgctacattgctgaaccgttcaaacgtgtagcttatgatgatgccattacccttctgcaagagcatgaagcggatgaagatacagattacgaacacatcgagcacggtgatgactttggttcacctcatgaaacatggatttcaaattactttggtgtaccaacctttgttgtgaactatccagctagctttaaagctttctatatgaaaccagttcctggcaacccagaacgtgtgctctgtgcagacttgcttgctccagaaggctacggtgaaatcatcggtggttcaatgcgtgaagacaactatgatgccttggtagcgaaaatggatgaacttggtatggacaagtctgaatatgacttctaccttgatcttcgtaaatacggttctgtaccacacggtggtttcggtattggtatcgaacgcatggtcactttcgtagcaggtacaaaacatatccgtgaagcgattccgttcccgagaatgttgcaccgcttgcatccgtaa

SEQ ID NO: 60 - DNA, 32554 bp, Streptococcus suis
tggactactcaatcgtcccattatcgagcgagggcagacagctttcctctgtcgtccgcttgaaatcattaaagaaaaaatgccagaatatgactggtcggattatttataaaaggagaaaatatgagtttacttacaaaaatcaatgaaacaaaaacgttcttggaagaaaaaggtttggtaaaacctgaattcggtttgattttgggttctggcttgggtgaattggctcaagaggttgaaaatgccattgtcatcgactatgcagatattccaaactggggtaaatcaacagttgttggtcatgctgggaagttggtttacggtgatttggcaggacgtaaggttttagctcttcaaggtcgtttccatttctacgaaggcaatccaatggaagttgtgactttcccagtccgtgtcatgaaagctcttggttgtgaaggcgtgattgttactaatgccgcaggtggtatcggctacggtccaggtacccttatggccattacagaccatatcaacatgactggccaaaatccattgattggcgaaaacttggaagaatttggtccacgtttcccagacatgtcaaatgcctatacaaaagaataccgtgaaaaagcccatgccattgcggaaaaattgggtattaagttggacgatggtgtctacctcggtgtgacaggtcctacctatgaaacacctgctgaaatcttggccttcaagactatgggtgcccacgcagtcggtatgtcaacagtaccagaagttatcgtggcagctcattcaggtatgaaagtcttgggtatttctgctatcacaaactttgcggctggtttccaatctgaactcaatcacgaagaagttgtagaagtaaccgagcaaatcaagggcaacttcaagggcttggtgaaggctatcttggctgagttgtaagcattcgaaaatagaacaaagaggtacattacatgtctatccatatttccgcaaaaccaggtgaaatcgctgataagattttgcttcctggtgatccgcttcgtgctaaatttatcgctgaaaacttccttgaagatgccgtttgcttcaacgaagttcgcaatatgttcggctacacaggtacctacaagggtcatcgtgtctctgtcatgggaacaggtatggggatgccttctatctcgatttatgctcatgaactcatcaatgactacggtgtgaaaaagctaatccgtgtaggaactgcaggttcgctcaacaaggatgtccatgttcgtgaattggttttggcgcaagcagccgcaactaattctcgtatgatcaatattgactggccagagtacgatttgccacaaatcgctgattttggtcttttagataaggcttatcatatcgccaaagaactcaacatgacaacgcatgttggcaatgttttatcatcagatagtttctattctccaaaattgtttagtcgcaacttagaattaggtcaactaggtgtcaaggcagtcgaaatggaagcagctgcactttattacctaggtgctaagtttggcgttcaaacgcttgccattatgacgatttcagatagcttggttaatccagaggaagacaccacagcagaagagcgtcaaaatactttcacggatatgatgaaagttggtttggaaactctgattgcagaataaaaaaataggcaaactatttatgcaattttgtataatagcttgtcttttttttataaatagggtataattaagaaaacggttacaaagaaagagtgaaatctttctgaatgattacatcaatatatctaggagaaaccttatgataaatttacaaaattttgttcaatctatgtatgctaaacgtattgaggattgtacagaccaagagctctactacgccttgcttgcttttacaaaacagcaaagtgaagccaaatatactaatgaccagaagaaaaaggtttactatatttcagcagagttcttaattggtaagctcttgtccaacaacctgattaacttaggtgtctatgacgaggtgaagagccagttagctgctgcaggcaaggatttgattgctattgaagatgttgagttggagccatctcttggtaacggcggtttggggcgcttggctgcctgcttccttgattcaattgctagtctaggtcttaacggtgatggggtcggcttgaattatcactttggactgtttaaacaattattcgaataccatcaacagtctgctgtgccaaacgagtggattacgccacgttcatggctgactgagtcaccgatttcttaccacgtgccatttgctaactttaccttgacatctaagttgtatgacatcgatgtaccaggttataagacagagcggaagaatcgcttgcgcttgtttgaccttggttcagttgatgacaatatcatctacgatggtatcgagtttgacaaagaagatattttccgaaacttgactctcttcctctatccagatgattcgaccgatgaaggtaaagttctgcgtatcttccagcagtattttatggtgtctaacgctgcgcaactattgattgacgaagcagttgctaaggggtcaaacttacatgacctgcctgattatgctgttgtccaaatcaacgatactcacccatcacttgttattccagaattgattcgtttgttggaacttcgtggcatttcatttgatgaggcagttgaaattgttaagaaaatgactgcctataccaaccataccatcttgtcagaggcgctggaaaaatggccgcttgacttcttgaatcgtgtagtgcctcacttggtaccgttcatcgtagaattggatcgtcgtgccaaagaagtgaaggatgatcctgctgtcaatatcatcgatgaacatggccgtgttcacatggcccacatggatattcattatggttattctataaatggggtggcagcacttcatacagagatcttgaaaacttcagagttgaaagccttctacgagctttaccctgagaagtttaacaacaagacaaacggcatcaccttccgccgctggctcatgcatgctaatccaagtttggcaagttacctagatggcttgcttggagatggctatcatcacgatgctagcgagttggaaaaacttttagaatacaagaatgataaggaactgaaatcttggttggaaaaaaacaagcaacacaacaagcgtaaattacaacgtcatattgctaaaactcaaggtgttgaagttaatccagagtccatctttgatgtgcaaatcaagcgcatgcacgagtacaagcgtcaacaaatgaatgttctttatgtcattcacaagtatttggacatcaaggctgggaatatccccgcgcgtccattgactgtcttctttggtggaaaggcagctccagcctacacaactgcccaagacatcattcatttgattttggtattgtcacaggttatcaaaaatgacccagaagtggcaccatatttgcagttggtcatgattgaaaactacaacgtaacggaagccagcttcatcatcccggcggcagacatttctgagcaaatttctcttgcatctaaagaagcttctggtactggtaacatgaaattcatgctcaacggcgccttgactattggtacagatgacggtgccaacgtggaaattcatgaattggtcggcgatgaaaatatctacatcttcggtcaagatagccagactgttatcgaccactatgcaaatggaacctaccatccatatgccttctacgaacgtgaagccatccgtccattgattgatttcatcacttctgacaccattcgtcaggctggtggtattgatgaacgcctctggcgcttgcaggataaccttaagcacaatgaccacttcatgaccttgcttgacttggaagattacattgtgactaaggaaagaatgttggctgactatgaagaccgtgacagctggttggaaaaagtcatcgtcaacatcgctaaagcaggtttcttctcgtcagaccgtacgattcaacagtacaacgaagacatctggcatttggaagcgaaatagaaactgggagcgggaaagaactcgactggtcaaagaaagagttcgtcaacaagtctttatttctagttgttgagctgaaacagtctattcccagacatcaatttttgtgagctgactgccgtcagcttatatctcccactttaaaaggtctcccagaccttttaaactcccacccccgtatagctcaaactgtctgggggacagtttgaggttggagatatagcgaacgaagttcgcaacagtcgttaagtcagagtagtgactgttggaggttggagatagagcgaacagagttcgctacaaaactgtctgggggacagtttgaggttggagatatagcgaacgaagttcgcaacagtcgttaagtcagagtagtgactgttggaggttggaaatgaagcgaactctgttcgcatcagtcgtaatggtcagatttggagtgtaaaacacgaattgctgagattttcgaagcaaatcctatctccaaccttcttcctcgctttcatgcttcgaggctcaggctgaaacagttccccgaactgtttcactccactggactattaaacccaatcaaccactgcgctgagatgttgacacgaaccctgagaagcgaggttgggctttttgcccaatgtcattaagttaactaacctatcacgttttgtggtgggttagtttttatgttacactaaaaataaaaggggaaaaagtcatgctagatcagattaaagctcatttacttgatagtattaacgacatcgtttctagtgccaatcagtttgtgcttcatcctgaaaaagattttagtcggcaaagtcagctaacgatgaaaaccatgattcaagctatactgaccatggggggtaataccttagccaaagagctacttgatttagatttgcctgtctctcaatctgcctttgttcaacgacggtatcagattaaacaccaagcttttaaagccctgtttaccaatattacttctaaaattccaatctctgataatctccctatcctggctgttgatggcagtgatgtgattctaccaagaaatcgttttgataaaacgacctcttttcaaactggaccacataacactccttacaatcttattcatatcaatgctctttacaatcttgaacaagagatgtatcatgatttacggatccaagataatcgagaggttgatgaacgtgcggcttttattgatatgatgaagaactcttctttcaaacaagctctggtaataatggatagggggtatgaatcctacaatgtcatggctcactgccaagaaagaaattggtcctatattattcgtattcgtgatgggaatcattctatgaaatcaggatttaacctccctgacaccccttgttttgatgaaaaatttgacctaaacatctgtcggaaacagaccaatgagatgaagcaacagtatcaaaattttcctaatcactatcgctgtttacctaatcacacatcctttgactttctaccaagctctagccgaaaaagcgacccagttcagttttacgaacttcattttcgaatggtgcgtctcgaaatcaagccaggtttctttgaaactttggtgacaaacaccgattattctccagaaaaattaaaagatctctatgcctacagatggggcatagagaccagttttcgtgacctaaaatacagtatcggtctgactcattttcatgcaaaaaagaaggaagggattctccaagaaatctacgctcgctttatcaattttaatgtttgtaaatggctaacctcacacgttgctattaaaacatcaaagttaaaacagacttataaaatttgtttttcagacgctgtttatgcctgtcgaaaatttcttagaaacaaactcacttccttccaattagaaacctacattgccaaacatttatccatcatccgacccaatcgaacgttccaaagaaagataaaaagcaaggcacctgtaagcttcacttatagagtaacataatagctgaaaaatagggttaaaaaacatcctttttgtgcgccctaaatacaaaaactgttcccgtttggtcatcaattgctcggacgggaatagtttctttagctgcttaaatgcttaacttaatgacattgggctttttgcccatcctctttatgttctgactttaaaagtatgagttgttttggattgtactaggagatttccaagggctaactaatactgttcaaaaaacaaaaactaacctataatagatttatgaatgtagcgttacaataggactttgaaaactttccgagagaaacttgacacaaacccattggaccattctattgcaaatgaagagattttttagtatactatgagtggctcatgtggactaacctcctgtttgtttcatcacttacagtatagtccatttgctctttttattatattttgaaatgaactagcataacgggtaagtaatagaaaggttatttatgaaaaatagaagtggtcgtaagaagtcttcaaggttaaagattttaaattacgcattatggatactatatgtcgttgtccttggattgactttgtttaccatgtatcgatttaatatcttaaattttagatatataaatcatattctaacagttctatcaatcgggattgtacttattacagcttggctgattggacggaaaaaggcgcgtgtcttaacaacagttatactggcattatcgttaatcgtagcatcacttggtgcctatggtatgaacgaagtcgttaagttttcgagccgtttgaactcgaattccgtatttacagagtatgagatgagcgtcatcgtgccagccaacagtgacattactgacatcagtcaactgtcttctgtattagcaccgtcagattatgatcaggataatataactgccttgctggatgatatcgctaagatgaagtctgttcaattgactaccagtccgactagttcatatttgacagcctaccaatcattaatcaatggtgagagccaagcgatggtaatgaatggagtctttaccaatatcttagaaagtgaagacccagaattttcgtcaaaagttagaaaactttatagctataaaatcactaaaactgttgaaacagcagtaggacaagcgagcggagatagttttaatatttacattagtggtattgatacctatgggccgatttcatctgtttcgcgttcagatgtcaatatcattatgacagtcaatcgtgctacccataagatattgttgacaacgacaccacgagattcttatgtagctattgcagatggtggacaaaatcaatatgacaaattaacgcatgctggtatctacggtgtaaatgcctctgtccataccttagaaaatctctatgggattgacattagcaattatgtgcggctgaatttcacttccttccttcaattaatcgacttggtgggtggaattgatgtatataacgatcaagaatttacaagtttacatgggaattactatttccctgtaggacaagttcatttaaactcagaccaagcattaggcttcgttcgagagcgctactctttaacagggggtgacaatgaccgtggtaagaaccaggaaaaagtgattgctgccttgattaaaaagatgagtgcgccagagaatctaaaaaattatcaggcaatcctatctggtttggaaggatctatccaaacagatttgagcttggaaacgattatgagtttagtgaatacccaactagaatcaggtacacaatttacagtcgaatcacaagcattgacaggtaccggtcgcaacgatttaccgtcgtttgctatgccaggttcacaactatatatgatggaaattaaccaagatagtctggagcaagcaaaggcagcgattcagtcagtattggatggaaattaaaaaataggagagattatgtataatcaggaagtaaatgcaaccgaaattgatgtgttatcacttttaaaaaccttatggagcaagaaattccttattattatcacagctctttttggagcggggattgctttcgtctatagtagttttttagttacccctcaatttgactccactacacggatttatgtagtcagtcaaaatgttgaggcgggagctggtttgacaaaccaagaacttcaggctgggacctacctcgttaaggactataaagaaatcattctatcacaagatgtgctatcacgtgtaaaaactgagctaggattggtcgaggatatatcagataaaataactgtcaacatcccagtagatacacgcatcgtttcgatcacagtccgtgatgcagatccaaatgtgtcagctcggattgcaaatagcttgcgaacagtggctgcacagaaaataatagatgttactaaagtgagcgatgtgacaacactagaagaagcggtgccagctgaacaaccatctacaccaaataccaaacggaatattgcaattggtatgttggcaggtactatgttagccgttggctttgtattaatcgtagatatattagatgatcgagtgaagcgaccacaagatattgaagaagtaatgggcttgaccttgcttggtgtagtaccagattttaagaaattgaaataggagtgaactatggcaacgttagaaattgcgcgtacaaaaagagagatagtaaataaaaccgaggagtatttcaatgccatccgtaccaacattcagcttagcggagcggatattaaggttgttggcattacctctgttcagtcaaatgaaggtaagagtacaactgcggctagtctcgctattgcctatgctcgttcaggttataagaccgttttggtggatgcagatatccgaaattcagtcatgtctggtttcttcaagccaattacaaagattacaggcttgacggattacctagcagggacaacagacttgtctcagggattatgcgatacagatattccaaacttgaccgtcattgagtcaggaaaggtttcacctaaccctactgcccttttacaaagtaagaattttgaaaatttacttgcgactcttcgtcgctattatgattatgttatcgttgactgtccaccattaggactggtaattgatgcagctatcattgcacagaaatgtgatgcgatggttgcagtagtagaagcaggctatgttaagcgctcatctttgaaaaaagtaaaagagcagctggatcaaacaggcacaccattcttaggcgttatcttgaacaaatatgatattgccaatgagaagtatagtgaatacggaaactacggacattacggcaaaaaagcctaatttctcagataacataagtttgataagtaggtattaatatgattgatattcattcgcatatcatatttggtgtggatgatggtccccagactatagaggagagtttggcattgattggtcatgctcatggtcaaggtgttcgaatgatagtagctacctcccatagacgaaaaggaatgtttgaaacaccagaaaaagttatcatgactaactttcttcaacttaaagcagcagtagcagaagtttatcctgaaatacgattgtgctatggtgctgaattgtattatagtaaagatatcttaagcaaacttgaaaaaaagaaagtacccacacttaatggctcgcgctatattctcttggagttcagtatgaatactccctggaaggacattcaagaaggggtaaacgaggtcatgttgcttggtttaacaccagttttagcccatattgaaagatatgatgctttagctttcaatgctgatagagttaatgaactcattgagaagggatgcatgacacaggttaatagtagtcatgtcttaaagcagggattaattggtgatcgtgcaaaggaatttaagaaaagagtacaatttttcctagaacaagatttagttcactgtgtggcaagtgatatgcataatactacgacaagacctccgtttatgaagcaagcctatcagattgtcaaagaagaatatggagaagatagggcaaaggctttatttaagaaaaatcctctaatgattttgaaaaatcaagtacagtaacctcatagaaatagtggaggagatatgggtaatgaaataggatatcgccaaacgaaattggcattgtttgatatgatagcagttgcaatttctgcaattttaacaagtcatataccaaatgctgatttaaatcgttctggaatttttatcataatgatggttcattattttgcattttttatatctcgtatgccagttgaatttgagtatagaggtaatctgatagagtttgaaaaaacatttaactatagtataatatttgcaatttttcttacggcagtttcatttatgttggagaataatttcgtactttcaagacgtggtgccgtgtatttcacattaataaacttcgttttggtatacctatttaacgtaattattaagcagtttaaggatagcttcctattttcgacaacctatcaaaaaaagacgcttctaattacaacggctgaacgatgggaaaatatgcaagttttatttgaatcacataaacaaattcaaaaaaatcttgttgcattggtagttttagattcagaaatagataaaaaaaatttatcattaccgatctattattctattgaagaagctatagagttttcaacaagagaagtggttgaccacgtctttattaatttaccaagtgaatattttgatttaaagcaactagtttcagaatttgaattattaggtatagatgtaagtgtcgatattaattcattcggttttactgcattgaagaacaaaaaaatccaattactaggtgatcatagcattgtaactttttccacaaatttttataagcctagccacatcatgatgaaacgacttttagatatacttggagcagtagtcggtttaattatttgcggtatagtttcaattttgttagttccaattgtaagaagagatggaggaccagccatttttgttcagaaacgagtaggaaaaaatggtcgcattttcaagttttataaattccgctctatgtatattgatgcggaagagcgtaaaaaagatttgatggctcaaaatcagatgcaaggtggcatgttcaaaatggataacgatcctcgcattacgccaattggtcatttcatcagaaagactagcttggatgagctacctcagttttacaatgtcttaatcggagatatgagtttagtaggaacacgtccgccaactgttgatgaatttgaaaaatatactcctggtcaaaagagacgattgagctttaaaccgggtattactggtttatggcaggtaagcggtcgaagtaatattacagattttgatgaagttgttaagttagatgttgaatacattgataattggacgatttggtcggatgtaaaaattttgctaaagacagtgaaagttgttattaagagagaaggaagtaaatagaagaggaaggttttattgttaatatattcgtgaagagtgaatattcgttaatattttctgaaaaaactaaaatttatcataattttgtgaaagaataatttagttatttcttatttgaactggtaatttgtttaaatcaggagttgtttaatttgaaaaaaataaaaattgctcatattatgggtaaatggcttggtggtggtgttgaatcaactgtattgaattatttgagggcgattgacacaaatcaagtggagtttcatctgttgtgtgattcggattcaaaagatataccatacgaaatcatagaaaaattaggtggaaaggtgcgaatcattccgccgtaccagcagttgataacgtattcaagaacattaacgcattttttgaaacaagaacagtttgatattgtacactcgcatattaatactttgtcagtatttccgttacgctgtgcttataaggcgggagtaccagttagaattgctcatagtcatactacaacaagtccaaaagaatttaaacgcaatcttttaaaacgaatattacgcttattttcaacaagatatgcaacacattattttgcttgttctaaagaggctggtgtttttcaattcggaaagaaaaatttgtcttctgttaccatagtaaataatgcaatggataaatggaaattttattttaatgcacagaatagaagtgaaattagaaagcgattgggtatccaaagtgaacaggtactttttgggcatgtaggtcgattttccccccaaaaaaaccaattttttattatccatttgtttcatgatttccatcttaagaatgaaaatgcaaagttgatgttgattggtgagggtaaagataaagcgaagtgtatcgaagaatgtgaaaaactaggtcttcaagagagagttgtttttgttgacaatgtacaaaatgttgaagcatattattctgcgatggatgtttttttatttccaagcttatacgaaggtttcggcatggtgctagtagaagcacaactttccggtttaccgtgcttggcttcatccgcagtcccaactacaacaaaaattagtgagcaagttacctatataagtaccaaagaaccaaatatttggttggaaataatgtttaaaatggcggaaaacatagatactgactcgcggttggaaaacatctaccgtttagaacagttagggttagatatagaaattgaagcaaaaaaattattaaatgtatataaaggagcaatgggtgaaaaaggtattacaattgggcgtgactgataatttaggtggtatcgaaacatttgctgctaatgtatatagatttacagataaaacaagaatacagtttgattttgggaatatttatagtaatccgttatgttttgaggaggaatttcgaagaggtggttcaactgtttataagttgccaaactattaccgaaatccgatttcttatatcaaagaaacaaaatatctgatagaaaaaaataagtatgacgttgtacactgtcatatgaactctgccgcaatgctatggccacttatagcagctaaagcagctggtgtcaaagtaattgtcgctcattcgcataactcatcttcagataaaggtgtgttgaaagatttactacatagaataaatcgtaatttcataccatttttagctaataaatatgtagcttgttcagatttagcggcggaatattttttttcaaaaaatttaatagaaagtaccaatttttcaattatcaataatgcaattaatgtaccacgctttcttttttcgaatatgaatagaaagcaaaaaagggaagagctgggagtggaggaagatgtctttttagttgggaatgtaggtcgatttacaccacaaaaaaatcatctttttctagttggtttatttgcaaaattctataagaaatttcctaagtcgaaattattgcttgttgggaaaggcgaattgaaagaaaagatacaaaaagaagcagagaaattaggtattctatcagaaattatctttttagaaaatatttctgatgttgaaaattattattgtgcgatggatgtatttcttttacctagtttgtatgaaggattgggcattgttttgatagaggctcaagtttcaggtcttcctatattgacttcaacgaatgtgcctactattgttaatttaggaatatctaaattttatgcgatagatttacaaaataaaaaagaatggttggataagttaactttagtccattcttttgaaaagaaagaagagcgacatataaatagagaatttgttaaacaaagaggttttgatatagaagcagaagtgaagaaaatcatggagttgtaccaggtatgaaacaagatatattgattagtgttgttattccaacatataatatgagtaattatttaaaaaacgtttatcaatcactttgtaatcaaaactataaaaatttggaaatattatttgttaacgatgggtcgactgacaatacaatctctgttctagaagattttcaacgtaaagatgagagggtaaagatagtaacgatagaaaattcaggtgtttctattgcgagaaatactggtttagaaattgctacaggtaattacgtttttttctgtgacgcagatgatgaattagaacctgaatgttttgaacattgcgtgaaagttattcaagacgatagtccagattttataaaagtagggtttgccaaaaaaattggcacagtgaaaaaagtaaaaaaattatctgttgaaacaaatacgctacattctggggaagattcattaattaatttagtacaaaacatgttttatcacgatgactttagtacaattggaggagtgttactaaaatcatcgcttgccaaaaaacatcgatttgatgcttctttttcaattggagaggattttttatatgtttcacaatgtctttttagtgcaatgtcagtttacgtcattggcaagccgtattatgtatatagagtaaatcaaaatagtgctacgcatcaatttgagattaataagacgctttctacgattgaaggacaattagaagtcgttaataagataactcacaacattgaagagcgattttccatagttgccgacagtggcgataaatgcaaaagaattatcagtgatacattaattggagttgctgaaaaaacaagctattcagaatataatcattttatttcactacttattcagcatgatggtattatgcgatatttaaaagaaaaaggtataacaaaagtagatattgatcaacagatggtatcaatatttgtgaaagctaaaattaaagcggtaataaaaaaggtgattcaacatggatttaattagcgttatcgttccgatatataatgtggaaaagtatctgcctaaatgtttagatagtattttagggcaaacatataaaaatatagaagtgatattggttaatgatggcagtccagataattcagaggcaatatgtttagcatatgctagcaaagataaccgtatcgtttattataaaaaagaaaatggcgggctgtctgatgcgagaaattttgggctagatagaatgtcaggcgagtttgtaacatttgtagattcagatgattatttagcgccacaatttttagaagatttgtatcacgcaataaaaaaacacgatgcacaagtggcaatgtgtccattccatatcgtttttgaagaaaatgacaacttaatcactaagtctttcttaacgcttaaaaatgtggttacaggcaaagaaatattaaaagaagtgttaggaaaagaaggatatgtttctgtcgttgcatggtgtaaattgtatgctagcagctgttttgacaatttgcgttttgataaaggaaaatattttgaagatgaatatattaattttaagttgttttatccgttaactaaagttgcgattgtcgaagaagcacaatactattatgttcaacgacaaaatagtataacaaattcaagctcgtcggaaaaaaagtttagagatatgattgaattttcagaaaatcgaattaggttttatcaattaaatcatgaaaatgagttggaaatgcttgctagaatacattattgtgattctcttattcgtacgattggctctgtttcaaaggtattaactttaaaaaatataaaacaagtgcaagaaaagtatacattaaattataatgtaattaattggaaaaggaaaaaaataagtagaaagcaacgtgttatttattttttagcaaatattgacttgcagacaattgcaaagatgttttatattttaaaaagtaatagaacatattaaaggagaaattttgatatgcttgcttgggataaaaaaaacaaacttaaaatattgtattatgccccagatgttttttttattaaaattttttcaacgataactaaaagagttcataagaaggaacaggcaattttaaaatttttaaaaaatcaaaatcctgattataaaaatactataaataaggaaaaaaattctattaaaccatttaataaagttatttggacattgtggtggcaaggagaaaaaaatgcccccaaaacggtacaaatcactttagaacgcatgaaaaaagttgctgagagaaatgcgtataaattcgttgttttagatcaagaaaatataagaaattatgttaatatccctgaatttgtttatgaaaaattagaaagaaaaattatttctttacaattcttttcagatattgttcgtttatctttattggcagaacatggcgggatatggtttgattcaacattgtttcttcatgaagaaatagatttaagtgtttttgaaacggaatttacaactattaaaattacaaatgctggagaagaaagcaaaaataatatttctcgttgtcgatggacgggattttgtatatcttcaacaccatcaagtcgctacactgtctttttaagagattttatactaagttatacagaaaaaaataatttccttgttgattattttttgcttgattatgccatttatttgttatatgaagcagataaagaatttaagcatgtgattgataatatgcctttagcaattgataatgataaattatttttctttaattatcatggaaaagaggtatttgatgctgaaaaatgggaacagctagtaattccgatagtaaaaacaacttataggtatgagtatggtgaaattgttaagggaacgtacttagaacgttttatctcatctgaattaaatgaagcttgaaaatagaaaggatgtttgtcgttgcagacgaaaattattatagagaagaataaattttttcaacatttagcaatattatttggagatgtattagtagccatactcattgttttgcagttttcaatcaatgttggctacgccaatcgaagccagacactgcttgcattattgctagggttaattctatcattctttttatatataaattataaattaaagtggcaaacatatacatatttattagttgcgttagtttcttctttactaaatcttctcttcattgagggggcggaatttcttttaattggctatgatttgctgatatgctttcccattgcgttatattttgttaagggaaactataatcggtggttttggaggatattttcgattgctctagcaatttttgtaataaataaatatatcacgagcacagacatatttaagtatcaaatattccctaatgcaagtaggaattacatttcagtgtttatgatttttgcaatgtttttattttgtatttccgaagtaaagtacaagaatgcacttagaaacttattcgtatttgcagttgtatcgtttatggcaagtattatggcagttggaaggggcggaattattgcgacaggcttcttactggtagtaattattttaattttatttaggaaatcatcattgaaaacgaaggggctgttactgctactgctttgtattttcttgtatgtatcagtaatcaatctggattatattttggacaattattttgttaggtttacaaaagataatgcaacaggaagtaattctgagcgttcatattttgtaacaacctatttacaaactatgatagtgaatccgttatatattttatttggggttgcacggagtagtttatctcaatatagggtgttgaatttccataattcttatttgcaatttcattttacatatggattaatacaaatgcttatttcagctaatttatttatatcatcgcttagaaagctatattcaaatgaacgattcacaatttttgcaattggattatgctttttggtaagagcgatgttagatatgttatttccagctcatttattgagtattgttttatactatttttgtcttctttcgacggagaatggtgatggagtttagcagagtatagtgcaatttttttggcagtgcagtaggagtattgtaagcgaaaattattttggaccaaaaaaaggggtggaaatgaaacgagtatatatatgcaatacagtatatcaagtgttaatttctctattgaagatggattttaaaaaggacactttgttatcagtaggaattgtaaaaaattttccaaatttgcgaaaagagttgatgtcatatgttaagctagtagaagttgaagaaaatctatttggtcttagatcaatactaaaggttagagaaaaaaaagaatggttattattttttcgaaattttgatgaagtaattatttttttggatcaccgtcaattgggacattttttgaataaacataggatttcctattctctaatggaagatgggtataatttttacaaagataaaagagtgcttaatttggatacattgcacccttcctttctgaaaaggattctgtatcgttggtattttcgaccgacgactttgattggttcaagtccctattgtcaatcgattgaagtgaatgatataaagcttgtgcaccaagacaaagcctacaaaccctttgtagaagtgtctcggaagcagttgtttgaaactatatcacaggataagctagaaagtttaattcagatatttggagttaagacgatttttgataagaataaagttagcgaaaaaaaaagcctcctacttttaacacaacccttatcttgggaatactatgtgacagacgaagagcgcctgaaaatctatcaagcagggcttgctccttatcggaaagagtataagatttatatcaaaccacaccctagagacaatcttgattattcagtactgggtgaagacacaattactgtaccccaaggagttccaattgagttgttcgaattagctggaaatatgcactttgaagttggaatgacctacagttcctcttcgatggattatttaaattgtttcgatgaaaaggtttttctttacgaaaaatttccgctttcttcaaaaacaaaaattgaataaaaaagttgacaaggagcattcatgtcaaaaaaatcaatcgtcgtatcggggctagtctatacgattggaaccatacttgttcagggcttagcctttatcaccctccctatctacactcgagtcatctctcaggaagtgtatgggcagtttagtttgtataattcgtgggttggtcttgttggtctctttattggtctacagttaggtggggctttaggtccgggatgggtacacttccgcgagaaatttgatgacttcgtatccaccttgctggtctcttcaatcgctttctttttaccaatttttgggctatcgtttctcctcagccagcccctatcgctcctatttggtttgcctgattgggtcgttccgcttatctttttgcaaagttttatgagtgttgtacaaggatttttaacgacctatttagtgcagcggcagcagtccatgtggactttactcatatcggtactgagcgctgttattaacactgctttatctttatttctcatcttttcgatggagaatgatttcatcgctcgtgtaatggcaaactcggcaacgacaggtgtatttgcttgtgtgtccttgttgtttttctataagaagattgggtttcattttcgaaaggactatcttcggtatgggttaagtatatcgattcctcttatttttcatgggttagggcataacgtactcaatcaatttgacagaatcatgcttggcaagatgctaacactgtcagatgtagccctatatagttttggctacacacttgcgtctatcttgcaaattgtgtttacgagcttgaatacggtgtggtgtccgtggtattttgagaaaaagagaggtgcagataaagatttgctcagctatgtccgttactatctggcgattggcctgtttgcgacttttggatttctaacaatttaccctgaattagcgatgatgttaggtggatctgagtatcgttccagtatgggatttattcccatgattattgtcggggtgttctttgtatttctttatagttttccagccaatatccaattttatagtggaaatacaaagtttttgccaatcggtacacttattgcaggtgtactgaatatttcagtcaactttgttttgataccgacgataggaatttatggtgctgctttggcaacgactgcttcttatctgctgttgctagtcttgcattattttgttgctaagaaaaaatatgcttacgatgaagttgcgattttaacatttgttaaggtaattgctcttgttgtcgtctatacaggcttgatgacaatgtttgtcggttcaatctggattcgctggtcactaggaatagcggttctagtcgtgtatgcttatgtttttagaaaagaactaacagttgccctcaatacattcaaggaaaaacagtttaaatgaaatagaaatcattgatttttctttcaaactaaagctagatttagctggaatatgtaaggacaatgtctggattatcaaaaatcttgcattttatcaagcgagatgataaaatgcggtaaacatgagcaaaccccaaaaataagtgttgcttcacaaattattatgccatatcatactaaattatggtataattaaactacaaaaaaagaagggaatgtttcttatggcgacaatgagtattacacgtcagatgacaatttcaaaagaagatgtaaaaaaaatacaagcttctaatcccactccactcttacaggaagtatacgcctctgttgacgctaaacgtcataaggtaaatctccctaaaaactgggtagaaaagtatatcaaatcatgaaattgacagctatttccttatcagaattctaccagtctattgaagagcatgttaagaatcaagctgtagaagcgacaagccctaagactattcgaaagaaagctagggctattttttcgggtgtcgtatctcaaatgatttcattcggcaaaaatcttgatatgcaggattatctgaaagatacggcgctgtcaatggaattaagtcatcgttcaaaaaattttattgttgttgatgaagataacttttacgttacaggagagtggctgggactcattacactctctttgaaggttgttgatatatcggatattgatgaacagtcaaagaaaaaaatggtaatggcaggtaaaagtatccataatattcaacacattcctgggatattaatagcacagctcggaaaaaatatgttattgaataattcggtgcagggaagtgatttattaaaattagcattagaaatgattgtatctgttcaaaacactattggagggaaaatggtattccttgatagtgtaaatcaccccaaaattatctccctttatgagtcatttggctttgtaaagtatggggaacttattcaagataaacatcgcataggagtagtttatcagccaatggcactggatttaacgaaaagagatatgattgattagttatggggacctctacaaactaattttctaaaatttaaaatgttgatttaacaaggcttttgtaactccaaattcgcaattttgggagtttatagaggtgcccttatttatattgttgttttacggaaacggtttatatttatttttagaaaggaaataaaatggtttatattattgcagaaattggttgtaatcacaacggtgatgtcaatttagcacggaaaatggttgatgttgccgttgattgtggtgtagatgccgttaaatttcagacatttaaggcagatttgttaatttcaaaatacgcaccgaaggctgagtatcaaaaaattacaactggagagtcagattctcagctagaaatgactcgtcgtttagaattgagcttcgaagagtatcttgatttgcgtgattactgtcttgaaaagggagttgatgtgttttcgacaccttttgatgaggaatcattggacttcttgattagcacggatatgcccgtttacaagataccatcaggtgagattaccaatcttccctatctggaaaaaattggtcgtcaagctaagaaggttatcctttcaactggtatggcagttatggatgaaattcatcaagcggtgaagattttgcaggaaaatggaacgaccgatatttcgattttgcattgtacaactgagtatccaaccccttaccctgctttgaatttgaatgtcttgcataccttgaaaaaagaatttccaaccttaaccattggttattcagaccatagtgttggttcagaagtacctatcgctgctgcggcaatgggagctgaattgattgaaaagcactttacgctggacaatgaaatggaaggaccagaccataaagccagtgcaactccggatatcttagcagccttggtaaaaggagtgcggatagtggaacaatcacttggtaaatttgaaaaagagccagaagaagttgaagtacgaaataaaattgtagcaagaaaatccattgttgccaaaaaggcgattgctaaaggcgaagtctttacagaagaaaacatcactgtcaaacgaccaggaaatggaatttcaccaatggaatggtacaatgtcttggggcaggtgagtgagcaggattttgaggaagaccaaaatatttgccacagtgcttttgaaaatcaaatgtaagcggagtaaggatgaagaaaatttgttttgtgacaggatctcgtgccgaatatgggattatgcgtcgcttgttgagctatctacaggatgatccagaaatggagttggatcttgtagtgacagccatgcatttagaagaaaaatatggtatgacggtcaaagacatcgaagcggacaagcgtaggattgtcaagcggattcccttgcatttgaccgatacgtctaagcagacagtcgccaaatctttagcgaccttgacagagcaactcacggatctttttgaagaagtccagtatgacttggtcttgattctgggggatcgctatgagatgctaccagttgccaatgttgctttgctttacaatattccgatctgccatatccatggtggtgaaaaaaccatgggaaattttgatgagtcgattcgccatgccattaccaagatgagtcaccttcatctgacatcaacggatgaatttagaaatcgtgtcattcaactgggagaaaatccccactatgtactgaatatcggagctatgggtgttgaaaatgtcttgaaacaagactttctgacaagggaagaattggcgatggaacttggaattgatttggcagaggattactatgttgtactctttcatccggttaccttggaggacaacacagctgaagaacaaacgcaagccttgttagatgcactgaaagaagatggtagacaatgtttgataattggatccaattcagacacacatgccgataagataatggaattgatgcatgaatttgtagagcaagacgctgattctcacatctttacttcgcttccaactcgttattaccattccttagtcaagcattcacaaggtttaatcgggaattcttcgtctggcttgattgaagtaccttcgttacaggttccgaccttaaatattggtaatcgccaattgggacgcttgtcaggaccaagtgtggtacatgttggaacatctaaggatgagattgttggtggtttggagcgtttacgtgatgtgatagattttaccaatccatttgaacaacctgattctgctttacaaggttatcgagctatcaaggaatttttagctgtacaggcctcaaccatgaaagagtttcatgatagataggggagaaagtttgatgaaaaaagtagcctttctaggagcgggtaccttttcagatggtgtccttccttggttggatagaagtcgatatgagctaattggctattttgatgataaaccgatcagtgactatcgtggctatcctgtatttggtcccttgcaagatgtcctaacctatttggatgatggaaaagtagatgctgttttcgtcactataggtgacaatgtcaagcgcaaggaaatctttgacttgattgccaaagatcattatgatgctttgttcaacatcattagcgagaaagccaatattttttccccagatagtatcaagggacgagggattttcttagggttttcaagcttcgttggagctgattcctatgtctatgataattgcatcattaatacgggtgccattgtagaacatcataccacggtggaggcccattgtaacattactccaggagtgaccataaatggtttgtgccgtattggagaagggacttatattggaagtggttcaacagtgattcaatgcatcgagattgcctcctatacaatattgggagctggtacggtagtattgaaatcgttgacggagtcagggacctatgttggtgttcctgctagaaagattaaataggtggattgatggaaccgatttgtctgattcctgctcggtcaggatcaaaaggattgccaaataaaaatatgttgtttttagatggtgtaccgatgattttccataccattcgagctgcgattgagtctggatgttttaagaaagaaaatatatatgtcagtacagattcacaggtttacaaggaaatttgtgaaacaactggggttcaagtccttatgcgcccagctgacttggcgacagattttacaacctcttttcaactgaatgagcattttttacaagatttttctgatgaccaagtgtttgttctcctacaagtcacttccccattaagaacgggaaaacatgtcaaggaggcgatggagttgtatgagaaaggtcgagctgaccacgttgttagctttaccaaagtcgataagtctccaaccttgttttcaactttagacgaaaatggtttcgctaaggatattgcgggattaggtggcagttatcgtcgtcaagatgagaaaacactctactatccaaatggagcgatttatatttcttctaagcaggcttatttagcggataaaacttatttttctgaaaaaacagcggcttatgtgatgaccaaggaagattcaattgatgtggatgatcactttgattttacaggtgttattggtcgaatttactttgactaccagcgtcgtgagcaacaaaacaaacctttttatcaacgagagttaaagcgtttatgtgaccaacgagtccatgatagtcttgtgattggagatagtcgtctgttagccttgtcactggatggtttcgataatatcagcatcggtgggatgacggctgcgactgcacttgaaaaccaaggtctctttttggctactccgataaagaaagttttgctttctctcggtgtgaatgatttgattactgactatcccttgcatgtgattgagaatactattcgccaattgatggaaagtcttgcttccaaagcagagcaagtttttgtgacgacgattgcctacacgctgtttcgtgatagcgtttcaaatgaagaaattgtgcagttgaataactttatcgttcagtcagcaagtgaactaggtatctcagtgattgatctaaatgaagtagttgaaaaagaggggatgcttgactatcagtatacaaatgatggattgcatttcaaccagattggacaagagcgcgtgaatcagttgattttgacaagtttgacaagataatttgatgatagaagcttattttaagcgattaggctatgttggtatgtattttagagccaaggaatgacatctgtaaaggatgctagacttgagaattgacaaccatttagttacacaatgatatatatacccagaaagaatgataaatatgtagttcgtatgacgaagtatcatcattctttttttgttttagtatattagtatatttcttcgtaatggtatgaatatcattgcgatcagagagagtaaatgtttgtttttcattattagctaccaacttgtcccatagtaagttctaccttatttttttgtctcagtctaatttccacttttggtgttagactagaacctactttgagaatttaggttacaaagaatgtactaaaatacttgaaaatcgggggggggtgaggtataattaactcagggtcttggtgacttgaaactagggaaaactgattttttgaacgcttcattttttctctggtaatatttattcaaaaggagtgacgatatgaatcgttcgaaaaagaaatcatttgattggtatggaatgcgtcagcgtttctctatccgtaaatatcatattggtgctgcaagtgttctgttaggtacgaccttggttcttggtacaggaacgattgtaggcgctgaaacaggagtcaatggggatggagcttcaaacgggcaaattgtacctgtaaataatgatgggatatccgatggcacgcagccacaaggggataatcaagggaacaatagctcaggagttcagactggtaatacaacaaattcaactgcgaatgaccagcctgcaggtgatacaggttcagtaagtagcctaccagtagggaccttacgttcagcagatactggaacacaaggagatggtttgactaaccaatctgtagatgaatcggttatcaaatttccgactcaagataatcaaacaccacctgctggttaccagagcgtactttttcactcttcatatgtgaaattggattttgaaggaaagcctggtgaaattgaaataactagaaatggaaaaccaatacaagttgttgctttttgggttaagactggaactacatggggaacattaaagaaggacccgcaatttagaattcctaaatatacagtagacgacggcgattttattttaggttatgatagaagtgttggacaagtaatacggccaacggatttcgattctctcgatgacactcctattgtagacacatgggagttcagtcccactgtggattacattgttggcgatgtttcagacggaaaaacatttgaagcatacatgaactcggggtcatatgctccataccaaattcttcaattccacggaattacattgaatgctaacggtggcacagttgacggcaaagcgaaaaaagctttttatgtggcttataagcatgtacaatggggtgacgagctagtaactaaaaaaatcgttgttccatccagagatggttatacttttgttcgttggcaaacagctacaggagaaggaatacctacttcgggacaaattgaaacgattgaatttactgctgtatggttaaaacatccaacagaagcggtaaaagtttttaacccagaacaactgagtgagactgataaaacaaaagttgcagacctgattcgtagtgtcaatcctgacttacagaatagcattcaagaaataactgtagcgaataatggtgatgctacggttagatttacaacgggtgaagagcggactatttcaggagcgagtttggtatcggacaactctgcagaacaacgcgctaaagctaaggaatctatctccgatgcagtattgcaaaaacaggatgatattgcaaaaagtcagctaacggcaaaagagcaacaagataagttagataaattgagagaacttcaagaatctatagaagagcagattgatggagcgacctctgaagatgctcttgataagatcgttgaagatggtaagaatagcattgaaaactttgatttaacgagtgctactaagaaaacagctgctaagcaagacttggaaacagcctacaatgctaagaaagatgagattgctaagtcagtcttgaccgcagaagaaaaagcagtgaaacaggcagaactcgaccaagccaaatccgtagcagacagcacaattgatgcagcaacagataatgcaggagtagacacagcactaactaacggtcaatccgcaatttctggtatcgacacaagcacaagtgctaagaaggaacaagctaagcaagacttggaaacagcctacaatgctaagaaagatgagattgctaactcagccttgactgcagaagaaaaaacagcgaaacaagcagaattggataaagccaaagaggatgccactaaatccatcgacactgctactacggatgattctgtacacaaggctctcacagaaggcaaatcaaccatcgctgccattgacacaacagctagtcctaagaaaacagcggctaagaaatacttagaagatgcttacaacgctaagaaagcagaaatcgccaattcaggtttgacagctgaagaaaaaacagcgaaacaagcagagctagaccaagccaaatcaacagcagacagcgcaattgatgcggcaacagatgatgcaggcgtagcgcaagcactaacagacggcaaatcagccattactggaatcgacacaagcacaagtgctaagaaggatcaagctaaggaagacttggaaacagcctacaatgctaagaaagatgagattgctaagtcagccttgaccgcagaagaaaaagcagtgaaacaggcagaattggataaagctaaagaagatgctgaaaatgctattgtcacagcaacagataatgcaggagtagacacagcactaaccaacggtcaatccgcaatttctggtatcgacacaagcacaagtgctaagaaggaacaagctaagcaagaacttaaagcagcagccgacgatgcgaaagcgtctattgacgctaacgacaacttgacagacgctgagaaacaagcagctaagaaagccgtagatgatgaagtagcgaaagctaatgacgccatcgacgtagcaaccaaagcagccgaagttgagacagccactcttgcaggtgagaaagcagtcgctaaggaagaactcaaggcagcagcagacgatgctaagaaagctatcgatgctaacaacaacttgacagacgctgagaaacaagcagctaagaaagccgtagatgatgaagtagcgaaagctaacgacgccattgatgcagcaaccaaagcagccgaagttgagacagccactcttgcaggtgagaaagcagtcgctaaggaagacttggaaatagcctacaatgctaagaaaaatgagattgctaactcatccttgactgcagaagaaaaagcagcgaaacaggcagaactagaccaagtcaaatcagcagcagacagcgcaattgatgcagcaacagattatgcaggcgtagctaaagctcttgaagatggcaaatccgcgattgacgcgatcaatacaactataagtgctgagaaagcagccgctaagcaagctcttgaaaaagcctacaatgctaagaaagaagagatcgctaactcagccttgactgcagaagaaaaagcagcgaaacaggcagaactagaccaagtcaaatcagcagcagacagagcaattgatgcggcaactgatgatgcaggtgtagctaaagcacttgaagatggtaaggctgcgattgacgcaatcaatacaactacaagtgctggaatcgacacaagtacaagtgctacgaaggcgcaagctaagcaagacttggaaacagcctacaatgctaagaaagaagagattgcaaactcatccttgactgcagaagaaaaagcagcgaaacaggcagaactagaccaagccaaatcaacagcaaacagcgcaattgatgcagcaacagataatgcaggtgtagctaaagcacttgaagatggtaaggctgcgattgacgcaatcaatacaagcacaagtgctggaatcgacacaagcacaagtgctaagaaggctcaagctaagaaagacttagaagcagcttacaatgctaagaaagcagaaattgaaaattctgcccttacagctgacgaaaaagcagcgaaacaagcagaattggataaagctaaagcagatgcagataaagcaattgatgcagcaacagatgcttcaggtgtagctaaagctcttgaagctggtaaagcagcgattgacgcaatcaatacaactacaagtgctggaatcgacacaagcacaagtgctaagaaggcgcataaggaaaacaaggttcttcctaagactggagataatgttggtttatcaagcgtcttgggcatagcaggtttagctttgttggggacagcaattcgtaaaaaaagagaagattaactattttcttaaggctctttgtcaactgtagtgggtagacgaaaagctaacacctagagaggacgaaattcgttctctctttcttcatgcgtacggcgtgacgagcccttgttattgggcggttacaaaagtctaacagtgtgctataatagttcttatgaaaaaacgaccgacatctgcctatatccacattccattttgcacccagatttgttactactgtgacttttccaaggtctttatcaagaatcagccagttgacgagtatttggcagccctcatggaagaagtcaagttttatgacctaccagccctcaagactctctacatcggaggcggaacaccgtcggctctctcagcagaacagttggactacctcctgaccaatctggaggacttgctggacttgtcacaggtggaagaatttaccatcgaggctaatccaggtgacttgacggcagataagattgcagttctgaaaaaatccaggtgcaatcgggtgtcgctgggggttcaaacctttgacgaccgtatgttgaaaaaaatcggtcgcagccacaaccaaacccagatttatgaaaccattgccgccctcaaggaagcaggtttccacaacatttctatcgacctgatttatgccctgcctggtcagaccatggagcaggtggtggacaatgtcgccaaggccttggagctggatattccccacatgagcctctatagcttgattttggagaatcacacggtcttcatgaaccgccagcgtcgtggcaacctccacctgcccaatgaagatgtggagtccgatatgttcgactacattctgcaagagttggagaaaaacggctttgagcactacgagatttccaacttcaccaagcccggctttgaaagtcgccacaacctcatgtactgggacaactccgagtattacggcttgggagctggagcatctggctacatcgacggcatgcgctaccgcaatcgcggccccatccagcactacctcaagtccatccgcgaaaaaggccattcccgcctgcacgaagagtttctcagcaagaccgagcagatggaagaagagatgtttttagggctacggaaaaaaactggcgtgtccattgagcgattcgaggaaaagtttggcatttcctttgaagaccgctacggtcaggtggtcagagacttgaaaaatgaaggtctcttgcaagaagaagaccattggcttcggatgaccaaaaaagggttatttctaggcgatacagttgctgaacgatttattattacagattagaaaagagcaaaaacaatgggcttaacctaccaagaagagttcaccattccctttgatatggtggatgttaaacaagaaattaaactgcctgactttatttcctactgtctcggtgtgtcaggtcggcagtcggaagaactaggtcgcagtgacctctatgtttttcaggaatttggcttgatttgggtcgtgacagattatgaactgaccattcaaggcctgcctaagtacaatgaaaccatcacgataaaaacagaagcggttgcctacaacaagtttttctgtcatcggatgttttatatctacgatgaagtaggtaatctcttactggatattctctgctattttgttctgattgattttgaaactcgcaaggtcgcgcctgtgccagaagctttgattgctccctatcagtctgagcaggtcaagaaattgcctcgggctcctaagtatcagttcttggaaaatccatctattcaagaatttcctgttcgctattttgacttggatatgaatgggcatgtcaataatgggaagtatctggaatggatgtatgaagcactgggctatgattttctgctctgccatgtccctaaaaaaatccaactcaagtatcttaaggaagtagaggcgactagcttggtaagttcgcgtatggtgtctaatgcttgtgtcagtcagcatgagattgtggtagatggacatatccatgcgcaagctgtcatagaatggagggaacgtcatgtcgcaggataagtggttggaatgggccgtacgtttacaagccttggctcagactggtttgtaaagatgtctatgatatggagcgtttcgaagaaatcagacagattgcggcggaaatgttgatagagctgtctgggcagcttgagaaagaaagttaaataaccaaggggcagtgcgcccctttttctgtttgcgagctatctcaaacccaaaaaaagaaagaacattccgtagttttttgaaatatatagtcgaatgaattagctttcagacaaggaactgaggtgcaggttgctagcacagcctag

SEQ ID NO: 61 - DNA, 36144 bp, Streptococcus suis
gcaaaaaatagaagacagcaaaaaacgggacttttaatcccgttttgttttttccttgatccattgactaacgttggacagggccttgctttgctctgccttgcgtttttgttcctggacaaaatctgcaaagctttgcttgacgccgtccttttggaccttgtcctgcaaatcatgccatttctttttaaggttgctggaagtccgttcgtagtagtcttcaagaatttcttccttggacttgtaattgcggtagaaggcattgcgtgacacaccagcttttcggaccaattcagataccgaaatttgcttgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatgggggagtttaatgatataattgtaagtaaatagagatttattgtcaaataaaaaagtaaaattggaaatgagaatattatgtcaaaatggaaaattgttgcagattcgggctgcgactatcgtcaattagctaatctagctccggacactgaatttattagtgtgccacttaccatccaagttggagaacaagtatttgttgatgatgcaagcttggatattgatcacatgatggaggtgatggaagcatctaagtctgcagcggggtcggcgtgtccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggactagattttccacaagtagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagtagcctttgaagaaatgaaaaaagcaggctatgatggtggtcgaattgtcatggcccaccgcaacaatgctaagttcttccaacaattctcagagttggtcaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttttaagttcgagggggattgtttgtatgagactattggatttcattcattcaaatatcttacgaattgctccagtttatctgcaaaatcttgttcaaagaagatctgtaagaaatcagctttctgtccgctgaaataataacattttccaaacatgtgttggatgctaggagaaagaatccccttgcttagctgaaaggtcacgctccctttggaaattcgataggggatgttcaaagcgtatttctctaaacaatcttttattttattccactgagcgtgataaatgtgatgaagatgctgtgtgttccgtgcaaacataccgttatcaatgtagagcgagagagctttttgcatgataagattggtatcgtagtcgattagactcttatgtttgatgaaggtataacgtagctgattaggaaggctgattgcaccgattcggagggcaggaaagagtgtcggtgtaaaagattttatgtagatgacacgattatctgtatcaagatagtgtaaaggtaggctatgactagagtcgaaatccgccaaatagtcatcctcaatgatgtagacattgtattgctttgctaattttacgatggctgtttttgttgctatatcataagttgaaccgagagggttgtgcaagcgaggaattgtgtagaaaaacttaatttttccagtctggaagatactttccaattcttctaggtcaattccatctaaatcccgttcaattgtttgataggggattccttgatgttgaatgagctctatcattcgtgaataggtagggttctctatcaagatttccgtttttccagccaaggtttccatttgtgtgagaatatatagagcttgttgactaccagctgtgataaccagttggtctttttttgtatagacatgatagtccattaacagactttgaacggaggaaatcaattctgccaatccctcttgctggtgatagtagttgaataggtaattttcccggccaataagactttcgtttagacaaatccgaaaatcttcatagggtaattcttgaaagtctgcaggattgagctctacagtatggtcttggaaatctctatcctctaagatataataaccgcttttttcgacagcgtagatcttattttggtattttaattccaacatagccttttggacagtgtctttgctacaatgatattgctcgctgagttgacggatagaaggtaatttttctccacgtttgaatcggtgttcctctattccagtcagaatatcttggatgataacttgatattttttcatctaggcccccttttttatagactatgttactagctagtatataggaaaaattgaagaaagacaatatatgaataatggggttgaggttcaggaattaagctactatatggtataattaagtgatgaaaataattatacctaatgcaaaagaagtaaatacaaatctagagaatgcctcgttttatcccctgcctgatcgaagtaagcctgtgctggatgccataagtcaatttgatgtaaaaaagatggctgccttttataaattgaatgaagcaaaggctgagttagaagttgaccgttggtatcgaatcaggacaggtcaagcaaaaacctatccagcctggcagttatatgatggtctcatgtatcgttatatggataggcgaggtatagattcgaaagaagaaaattatctacgtgaccacgttcgtgttgcgacagccttatacggattgattcatccttttgaattcatttcacctcaccgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcttttcatggaagaaaaagcaggtcagctaaaagttcactcgactatatcaaaaaaaggtagaggaagattgctgtcctggttggctaagaacaatattcagaaattatcggacattcaagattttaaggtggatggctttgaatattgtactgaaaaatcaacagagaatcagctgactttcatacgctcagttaaaatatgaaaaaaagaacaagatatgaacaagattgaacaagataacgtttttcatcactaaatatggctatgtggctagtaaaatattgttttttgtgatacaataggtgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttgaactatattgtaacaatcctgttgataggggttgcagtattgactggcttgttgatgtggcgtaagaaagcacgcatatttacagcactcgtacttattttttcactggtcatcacttctgtcggaatctatggaatgcaagaagttgtaaaattttcaacacgactaaattcaaattcgacattttcagaatatgaaatgagcatcctcgtcccagcaaatagtgagattacagatgttcgacaggtcactaatgtacttgctccggctgaatacgatcaagacaacatcactgctttattaaatgatatttccaaaatggagtctactcaattaactacaagtccgacgacctcttatctaacagcctaccaagctatgctaaatggtgagagtcaagcaatgattttcaatggagtttttaccaatattttagaaaatgaggatccagacttctcttcaaaagtgaggaaaatatatagtttcaaagtgactcagactgttgatacagctattaagcaggtgagtggagacagttttaatatctatattagtggcattgatacatatggcccaatttcgtctgtttcgcgttcagatgttaatattattatgactattaatcgagctacacataagattttattgacaactactccacgagattcttatgttgctatcgcagatggtgggcaaaatcaatacgacaaattaactcatgctggtatttatggtgtcaatgcctctgtgcataccttggaaaatctttatggtatcaatatcagtaattatatccgtctcaactttacatccttcctacagttgattgatttggttggaggtatcgatgtagaaaatacccaagagttcacaagtggtgaacacactttcccagtgggaacagtacacttaaatgcagagcaagcgctaatctttgttcgtgagcggtattcgttggctaatggtgataatgaccgtggtaaaaaccaagaaaaagtcattgcagcacttataaaaaaattgagctcaccagagaatttacgtaattatcaagctattttaaatagtttagaaggatctattcaaacggatctaagtattgaaacaattataggcttagttaatacgcaattagaagctggcacacaatttacagtggagtcacaagcgctagttggaaatggtcgaacagacttgccttcttatgccatgccggactcacaactttatatgttggaaataaaccaagaaagtttggaacaaacaaaggctgctattcagtcagtattggatggaaattaaaaaatagggagaagacatgaataatcaagaaatgaatacaatcgaaattgatattttactcttactgaaaacgatttggagaaaaaaaatctttatccttctgctgggactattaggtgcagggttagcttttgcttatagtagttttttggtaacgccgcaatatgattcgacaactcgtatctatgtagttgggcaacatgctgaagctggcgcgggattgacaaatcaggatttacaagctggatcttatttggtaaaagactatcaggaaattatcctatcacaagatgtactgacacaggtggttacagagttgaatttgaatggaaacctaaaagaaaaggtttcggtttctattcctgttgatactcgtattgtttctatctccgtgcgtgattcgaacccgaatgaggctgctcgcattgcaaatagtctccgtactttcgcatcgcaaaaaatcatcgaagttacaaaagtgagcgatgttacaacactcgaggaggctgtcccagcagaggagccatcaactcctaataccaaacgcaatatcttgcttggtttattagccggcagtatcttggcaacaggtctcgtgttggttatggaaattttggatgaccgtgtaaaacgtcctcaggatatcgaagaggtaatgggattgaccttacttggtgtagtgccagattcgaagaaattgaaataggagaaaaatatggcgacattagaaattgcacgtacgaagaaagaattagtaaataagacagaagaatattttaacgctatccgtacgaatattcaactcagtggggaagatattaaagtggttggcataacttctgtccaatcaaatgaaggaaagagtacaactgcagctagtcttgctattgcctatgctcgttctggctacaagacagtcctggttgatgccgatattcgaaactcagtgatgtcaggtttctttaagccaattacgaaaattacaggtttaactgattatttagcaggaacaaccgatttgtctcgggggctatgtgaaacaaatattccgaatttaacagttatcgagtctggtaaaatatctccaaacccaactgcccttttgcaaagtaagaattttgagaacttattagctactcttcgtcggtattttgactatgtgattgtagattgtccacctctagggatggtaattgatgcggcaattattgcccagaagtgtgatgcaatggttttagtagcagaggcaggacatgttaaacgttcagccgtgaaaaaagtaaaggaacagttggagcaaactggaacaccgttcttaggcgttatcttgaacaagtatgatattgcaactgagaaatatggtgattatggaaattatggtaactatggaaattacggtaaaaaagcttgatttttatgatatgagctttgattaagtaggtgttagtatgattgatgttcattcgcatattatatttggtgtggatgatggtccaaagacaattgaagagagcctagatttgataggagaagcttatcgccagggggctcgcttcatagttgctacttctcatagacgaaaagggatgtttgaaactcctgagaaaattattatgactaattttgttcaagtaaaagagagagttaaagtagcttatccagaaatgactttatgttatggagcggaactttactataataaagatatcctaagtaaactcgaaaaaaaggaagttccaactcttaatggaacgcgctatattctcctagaatttagtaagaatactccttggaaagaaatccaagaggctgtgaatgaagtaatgttacttggactgactccactacttgcccatatagagcgttatgatgctctggcatttcagtcagagcgagtagaagaattaatcgacaaggggtgttatactcaaattaatagtagccatgtgttaaaaccaggtttaattggtgaccgagcaaaagagtttaagaaacgggcgcggtactttttagagcaggatttggtgcactgtgtggctagtgatatgcataatttatcaaatagacctccgtttatgagagaggcttataagttaataacagaggaatttggggaagatagagcaaaagctttattgaaaaagaaccctcttatgttattaaaaaaccaggtgatttaagctggttactctagattttggagaaaaaaatggatttaggaactgttaccgataaactgttagagcgcaatagcaaaagattgatacttatatgcatggatacttttcttattgtagtttccatgaatttgagtagactattcttggatattattattgacattccagataaacgtttcattcttgcagttttatttgtattgatattctatctgattatttcagttagattaaaggttttttcgttaattacgaggtatactggttatcagagttatgtaaaaatagggttgagcttgatatctgcttattcattatttttaattatatcaacgattttatggcagagttttagctatcgcttcatcctagtatccttatttttgtcatatgtattgctcataaccccaaggattgtttggaaagtcttgcatgagacacgaaaaaatgctattcgtaagacggatagctcactgcgaatcttggtggtaggtgctggagatggtggaaatatttttatcaataccgttgaagatcgaaaattgaattttgaaattgtcggcatagtcgatcgtgatccaaataaacttggaacatttatccgtaacaccaaagttttaggaaatcgcaatgatattccacgcttagtggaagaattggcagttgatcaagtaacgattgctatcccttccttaaatggtaaggagcgagagaaaattgttgaaatctgtaatactacaggagtgactgtcaataatatgcctagtattgaagatattatggcgggaaacatgtctgttagtgcctttcaggaaattgacgtagcagatcttcttggtcgaccagaggttgttttggatcaggaagagttgaatcagtttttcaaagggaaaacaattcttgtcacaggagcaggtggctcgattggttcagagttatgtcgtcaaattgctaagtttacgcctcaacgattgttgttgcttggacatggggaaaattcaatttacctcattcatcgagagttactggagaaatatcgaggtaagattgagtttgtccctctcatcgcagatattcaagacagagagttgatttttagtataatgtctgagtatcaacctgatgttgtttatcatgctgcagcacataagcatgtccctttgatggaatataatccacatgaagcagtgaagaataatatttttggaacgaagaatgtggctgaggcggctaaaactgcaaaggttgccaaatttgttatggtttcaacagataaggctgttaatccgccaaatgtcatgggagcgactaagcgtgttgcagaaatgattgttacaggtttaaatgagccaggacagactcaatttgcggcagttcgttttgggaatgttctaggtagtcgtggaagtgttgttccactattcaaagagcaaataaaaaaaggtggacccgttacggttacagactttaggatgactcgttatttcatgacaatcccagaagcaagtcgtttggttatccaagctggacatttggcaaaaggcggagaaatctttgtcttggatatgggtgagcctgtacaaattttggaattggcaagaaaagttattctgctgagtggccatactgaggaagaaattggaattgttgaatcaggtattcgtcctggggaaaaactctacgaggaattactatcaacagaagaacgtatcagcgaacagatttatgaaaaaatatttgtaggtcgcgttacaaataaacaatcagacattgtcaattcatttatcaatggattactcaaaaaagatagaaatgaattaaaagataagttgattgaatttgcaaaacaagaataagaaagtaaaaaaatatttttactttcctagagtttaaacgatgtttaggttctaggatggttgaaatacttaatgaatatagtattggagagttggttccaagatatttaaaatctagtaaatttgctttatattatataggagattatcggctttatagatatgaatgagttgataaggataaaattaaaaatggagatgaaaatgtatccaatttgtaaacgcattttagcaatcgttatttcaggaagtgctattgttattctgagtccaatcttattattgattgcattggcaattaaattagattctagaggtccggtactatttaaacaaaaacgagttggtaagaataaaaagcacttcatgatttataaattccgctctatgtatgtagatgctccaagcgatatgccaacccatcttttgaaggatcctacagcgatgattacaaaagtaggagcttttctacgaaagactagtctcgatgaattacctcagctattcaatattttcaaaggagaaatggccattgttggtccacgtccagccctatggaatcaatacgatttgattgaggagcgagataaatatagagcaaatgacattcgtccaggtctgactggttgggctcaaattaatggtcgtgatgagttagagattgatgaaaagtcaaaattagatggttattatgttgagaatatggggctgctgcttgatattaagtgtttttttggaacgtttattagtgtagtaaaaagtgaaggtgtcgtcgaaggcggaacggggcagaaagggaagtcatgaaaagagtattgataacaggagcaaactcatatattggaacttcgtttgaagaatacgtaaaaaataaggatagtaattttgaaattgatactcttgatttattagatccaaattgggaagagtttgatttttcaggctatgactccttgtttcacgtggctggaatcgcacatttttcaaaagatgaaagtcagaaaaaactttactatgatgtcaatacagaattaacctataaagttgccttcaaagctaagctgtcgaatgtacaacaatttatctttatgagcagcatcatcgtctatggtgatagttcaagttcagaacggattattactagagaaacagttccaactccttctgatttttatggagatagtaagtggcaagcagaaaaaaaactgtcaggcttggccaatgatgactttaaaattgttatcgttcgtcctccgatgatttatggaaaaggatcgaagggaaattatcctcggcttgccaaattggcacgaacattgccaatattcccaaaattttcaaataatcggagtatgctgcatattgacaacttgtgtgccttcatcgaaggtgttattatagcgggagagcggggagtcttctttcctcaaaataaagaatatgtatgtacctcagatttagtgaaaaggattgctgcttctcatggaaaaaaaatctatctggtatccattttcaatcccttcatcaagttattgtttcattttgatacagtgaagaaagtatttggaaacttagtttatgagcaggaaatgagccaatatacttttgagtatcagataaatgattttgaagagactattagattaacggaagaatcaacctaatgaaagttaccattgttaactgttttgatacgtatgaacaccgcgttgaattattaaaggcatattttgagaaaagaggggcagttgtatcagttcttgcttctgattataggcatttccaaaaagaatatcgatcagattgtaaaaaagattataattttatacatgcaagaagttacaagaaaaatttgtcctacagtcgcttgaggtctcactgggaactgtcaaaggatatttttcgtgaggtagacgaaattattgatttgctgtgggttttagttcctccaaactcttttgttaaacaggcagctaaatataagaaagcaaatccagcagtaactttaatattcgatattattgatatgtggcctgaaacgatgcctatgggtgcgttaaaacagttcttcccttttactttatggggagacttgaggaatcataatttgtcagcagcagattttgtggttacggagtgcgacctatatcagaaaaagctttcaaaatttgttgacactacaaaaatgaaaaccttatatctagcgcgagaaaataagcaccttcttatcccagtagagggtgaattatctagcgagcatatttcaatttgctaccttggttcaatcaataacattattgatttgtcggctattagagtcatattagactctttttctaaggtgtttccaacgaaatttcatattatcggtgatggagagaaaaaagaagaattgctaagtatgcttggagaattaccaatagagattatagatcacggaaaggtttttgaagcccagcgaaagaattctattttgcagtcttgtcattttggactaaacatcatgaagaaatcagtatttgttggcttaacaatgaagagcatggattactttgaagcaggacttccaattattaacactattcaaggagacacagcgcgatttgtttcagaatttggaataggattaaatgtttttgatgaagaagtggattttagctcatatacctatgatttacaaatgcgagccaaggttcgtcaattatttgaatcttattttacagtagaggcttttgaatcctgtttggatcagattatgataggaattgagagagatgagaaaatcaaattatagtttgtgggagcaaatagtcaatctgctatttcttatcaggacaagaatagttgttccttcagcacgtttacttcgttttccgctaattattagaggtaagcagtacattgattttggtagggaacttactacgggtaggcattgcaggtttgatgttatatctgagcatgcagagaaagcattgatttttggaactaaagtcaatgttggagacggagtaagaatttcttgtgtagaaagaatttgtattgggaataatgtcttaattggttcacgggtactccttattgataattcacatggaacatatacagggaacattcaggatagtcctgaaacgccaccaaatgaaagaaaaatattttcaaaagcaattaaaattgaagataatgtatggattggtgaaggggctgtaatacaagccggggtcacggtaggctttggaagcatcgttgcagcaaatagtgttgtcacaaaaagcgtcccaccaaaaacgattgttggaggcgtaccagcagttccattgaaaaaatttgaacctataactgaaacttgggagagaataaaggggaatggggatgaaggataaaatcgttattagtggcattaacctatttgaaggtgggccattgtctatttattatgattgtttaaacgagcttattcgaaaaggcatacatttgaagaaagaaattatagcctttgtacacaggctagatttatttgaggaatataaagattatgttactttaattgagtttcctaaatcaaggggaagttatctcaagagattgtggtatgaatatgtttacttttactgcttctcaaagaaaaataaagtagatatatggatatcccttcatgatattactcctaatgtaaaggctaataagatctacacctactgtcataatccatcgcctttcctgaaaaaatctattaaaaacttcagatatagcattacgaattcattattttctcttttctataaatatctgtacaaaataaatataaaagctgctactgcggtaattgttcaacaagattggatgagaaatcgttttttagagatgtacccaataaagaatgtcattgttgcttatccagaatttgaagctgagcaggattttaattttatagatagacataataaagagaagcctgtttggatttaccccgcttttccaagattttttaaaaattatgaagtgattggtgaagcagtaaaaaatattgaagaattagattttgaagtctggttcacgatagatggaacagaaaatcgttattctaaaatggtatttgaaaaatataaacacctctcgcagataaaatggttaggaaagaagtctcgaaaagaaatattccaattatatgaggaggcttcggggttgattttttcatcaaagttggaaacatgggggttgccaatttcagaatttaagcggacaaggaaggatattattttgtctgatttaccctatgcacatgaaacattggggacgtattcaaaagctttattttttaatcctgataatggtacagaattaagtactattttacgttccattattgatggaacgcctgaatataataatgttgaagcaaaggcaatttcgcagccatttagcaaaggatggagtgaattagttgatttgctgttatctgattaaagggggtgaaatctgttcatgagaaatattcaagctgcgattgtggtttggtttaatccaagctctgaagtaattgaaaatatagatagttacattgatgatgtggctacagtttattgtatagataattcggatggtgataatagtcatttatatagccatgaaaaatttaagtactttccacaatttaggaatgttggcttagcttcagctttaaaaattggttgtgatttagcaattcaagatggtgcgacgattataacaacttttgatcaagatacattttgcgaagccaatattgcaaaaaaaatggcagataaactcttaaaaataaaaactgttggattagttgcaccaaatataaaatacatatatagaaatgaagagactggcgagcgaatactctcagaagaaattgtagcttcccctcattcagaacattgggttatcacctctggcagcacattcagaagcagtacttatcaagaacttggaggatttgacgaaaaattatttattggtcaaatcgatcaagatttctgttttaggttattgcaatgtaggtatcaaataattcaactatcagattattttatttatcaagaattaggaaatactataaaaaagagattttttggaaagttaatatctattcctcatttatcgccgattagatactattatatatttaggaatgaaagatacttaagaagaaagtggaagcatgcatatttgccatatcaagtttctctgcacaaatacttgattagcattatcctatttgaagaagataaaatttccaagctaacaaaatgtttgaaaggatattgggatggcaaaaaaatttagtgtttctaaactctatacatgggcacttgttttacttcctctagtgtcgatttatggaatttcagagattaatttggacttcggtaccttagcgttattattgctcctaccatttgtaatcaatgaacaaggaaagatagttctcgagaaacgcatagtctttccttggcttctatatgcgatatatattgtaataagtctttattttccgactatttttggaaaggaaacttatttaacgaacggttctatgtatgtgagggcttttaagaatattttatatatatttattcttatcttaagtacgtccagagggattattaacaaagattattttgtacagatttatctaaagataactaaaatatgtacatattatatcttcatacaagctgcattatattatactattcggttcaacttaccagggtacatcaatattatgttggttgcagaaggatatggagaacggttggatgtgacgagtttcagtctatttaggccgacttctttattttatgaacccgctcatttttttgaatatgttgtcattggtgtaataatatatctatttagatataaagagacgcctaaaaatgatatttttaatgctattttcttagcattaggaatagtcctatccacctctggaatgggtattcttactatagcgggtatttttggtttttggctactacaacaattgagtcgtactaagtttattcgtgtcagaaaagaaatattttttctaactgtaataggattgatagcagtagcattctttctacagagtggttttggtcaaagtgttttatcaagactatttgatacaggtacaaattattctgctttagatggtcgtactgaaatttatgaaaggatattcagttttgatacaggtagggtattacttggctcagggtacgggaatgtgctggagcactatttctatccaagttgggcttttagtttatggtgcttaggtattataggctcatctgtcattgttatactttatctactagcttatttccagagtagagttactattgcgaaaattattgtattagtaaattttatgttatgctttgtttctacactttttatgggaaaaaatttattgctttattttctttttgtttacatattaagtagggctgatgaggaacaatatgaataaggaaaaacatctactaattttggtagattcatactatcctaatgcaagtatgaatggtattattgcacagaggatagctaattatgtacaaaataaatataagataactttgttaacatatcaatctccttatgataatgcggaagctaacttttcagaaaaagtttttaattggagttggtattatgaagattatctatctgctagagtaaataaggaaaaatctaaaaaaatatgggggatattgtataaggcaaaaaaaatcttatcaaacatagttcgaaatagtagcggtgttggagtggataatattgtagtgaacaaaattgtaaaaaaaatacaggcaattcatcaagacaatccgatagacactatcctatcaatagctgctccatttgagtttcaactggctaattattattttagtaagaaataccccgagattaattcaatcatttatcaagtagatttttggagcgaactaattgatgtgggtttaccaagtatatttaggaagcgtcgaaaaaagtgtcgtatagagatggaaaagaaaatggctagtcaaggtacatatgtcatgattccatttgtttatgaaaaagagaaagttgtggactcaattcaatcgtgccaactcccattgctagcacccaatcagtttgtaagaaatcaagaattaaattctcaaaagtccattagtattgtttatgctggttctcttagtaagcgagaaagaaatccagagaattttttaagattgttatcgaaactttctgaagaagttgattttaaaatgtctatataccataggggagattgtagcgacttgattaacgcctattcctctcagtcatcatctattctaaattatgggactgtatcgtctgaagttgcttaccaggcgattggcagtgcagatgtattaattatgtttgggacacctgaaggaaaacaaattgctggaaaaacattcgattacatttcgacaggaaagaaaattatttatgtttaccaaaatgctacagataaaaatgtagagtttttgaaggtatacccacatagcatggcaatttcaaatgatgagttatcaaatgtagtgagttatagggctataaagaacttcatagaaaattctatcgaaccactttcttattcagaagtagaagatattttttctgactcgttacctcagaatttttgtgaacgttacttataagatgaaacagaggttataattgaaaaagaaattattcggagcaggtattttttacctactaggaaacatttttgacaaggcgattgcttttattactgttcctatttttactcgtctactttctccagcagattatgggattgttacaacatatctgtcttgggctagtatattatctgttgtattgactttgtctattagtgaatcggtccgttctgccgttatcgattttcctgaagagatggataattatctgtcctccatgtttggtctcggaaccctgagtgcggttattcagaccacagtgatttgtatagtatctctctttattccaaatgttttttcgttagaaataatattgtattgttgtctccaggcctatgcagtaagtatgataacaatggtgcagtggcatcttgttttagactatcggtattttttacgaacaattacccagagcatacccaacatggtcattattttgctttcgattttttggattcaaaaccttgagacggataagtatttaggtcgaattttacctaatgctcttgttttatttgtgacagcgctcatttgtttgattgtctattggttaaaagggaggacaatttataaaaaagaatattggagttatgcgcttaaattttctattccagtaatcttccacttattatctacagttgtcttgtcacaagctaatagaactatgatattattttggtgggatagtagtgaagctgggttgtatggtttggcatatcagtttggtcttattccacttgttatgacgacaactctggaaaacttatggttaccgtggttcacagagaaatattctaaaaaagaaaagcaattaataaaccaagttgtatcaccgtttatttggatttctttactggcttgtattgtattaattatggtgttctatgaggtattggtgttcatggttgagcctgcttactatggttcagctgccaatattcctcctattattgcctcaacatattttatgtttctaacttctacttttgttaatttagaatactatttaaaagagaccagagctgtcgctactaatactattattgttgctgctttgaatattgtgcttaattatgtgtttattcctcaatatggagcggtagctgcgtcatattctagtctagcgtcatacattgttctatttgttttacattatgtaaaagcgagacagttagatagtgatgtattttctataaaattatacgtctttccggttttattgatgttggtatcaacagtgggaggaatgtttttgttagaaaatgcacttgcacggtattttattgtatttatttgtatgctcttgagtatttatttactttacaaatattataaattattcaaagcaggataaggagaaaaaatgtcattattttcaggaaaaacactattaattacaggtggaacaggttctttcgggaatgctgtgttaaatcgctttttggcgacagatattgcagaaattcgtgttttttctcgcgatgagaaaaaacaggatgatatgcgccatgaatttcaggctaagatgcccgaagttgctcataaaattagtttctacttgggagatgtccgtgatttgcagtcggttaaaaatgccatgcacgatgtggactatgtatttcatgcggccgctttgaagcaggtgccgtcttgtgaatttttccctattgaagcagtgaagacaaatgtgattggaacggagaatgtgttgacagcggctattgacgcaggtgttgaaagtgttatctgtttgtcaacggacaaagctgcatatccagtgaatgctatgggaacttctaaagcgatgatggaaaaagttgttgtggctaagagtcgaacaactacaaaaacgaaaatctgctgtacccgttatggaaacgttatgtgttcacgtggttctgttatccctctttggattgaacagataaaatcaggtcaaccattgacaattacagatggtagtatgacacgttttatcatgagccttgaagaagctgtagatttggttctctttgcctttgaacatggtcaaccaggagatattcttgttcagaaggctcctgcttgtacgattcaaacacaagcagaggcagtgtgtgagttgtttggaggagataaagaagcgattcgtgtcattggggttcgtcatggagaaaaaatgtacgaaaccttattgacaaacgaagaatgtgctaatgcgattgatttgggtgatttctatcgtgtgccttgcgacaaccgtaatttgaattacgataagtattttaatcaaggagatgttgatcgtaacccactgacggaatttaatagcaataatacagagttgttgtctgtagaacagaccaaggaaaaaattgcttccttggcctacattcaagaagaaatggcaaagttaggaaaataggaatgacaaaatatacagaagtaaattggaaaaacaatggcaaactgaaacttttgattattgttggaactcgcccagaaatcattcgcttgtcagaggttattaagaaaacccgtcgttattttgatgtggttctagcccatactggtcaaaactatgattataatttaaatggtattttctttcacgatttgaatttggaagatccagaggtctatctgaatgcggtaggtagtgatttgggtgagaccatgggaaatattattgcagaaagctataagctaatggttgcgattcaaccagatgcagtacttgttctaggtgataccaactcttgtctttctgttattggtgctaaacgcctgcatattcctatcttccacatggaagccggaaatagaagtaaggatgaatgtctaccggaagagaccaatcgccgtattgtagatattatttctgatgtcaatatggcttactccgagcatgcccgtcgttatctagctgataatggcctacctaaggagagaacctatgtgacgggttcgccgatggctgaggttttgagggtgaatttagaaaaaattgagtcatcggatatccaccagcgtttgggtcttgaaaaagggcgttacattctgttgtctgcgcaccgtgaagaaaatattgataccgacaagaacttcatcagtttgttcactgctgtaaataagatggctgagaaatacgatatgccaattctgtattcttgccatccacgcagtaaaaacaagctggaatcatcaggttttgttttggatagacgtgttatccagcatgagccgctaggattccatgactataattgtttacagatgaatgcttatgttgtcgtttctgattcaggaactctaccagaagaatcgagtttcttcacttcagttgacaagcctttcccagcagtttgtattcggaccagtacggagcggccagaggccttagataaggcagatttcattctttctggaattgatgaaattggtctcctgcaggctgttgatgtggctgtagctatgaatgagcacaaacatttaggcttgccagtacctgattatgttgatgaaaatgtatcagataaggttgtaaaaattattcagtcctatactagcatcgtcaataagatggtttggcgtaaatactaaggagacttcctatgaaaattttagtaacaggcgcaaagggaatggttggaacagcattggtaaatcacttgaagacgattcaaagtgggaaaaacagaacgcgtcctaatctccatatccaatctatttttgagtatgatatagattcgacgattgaagaattagagcagtattgccaagaggcggactttgtttttaatcttgcgggtgtaaatcgtccggagaataccggagaatttatgcagggtaattttggcttcgccagtcagctattggaacagctcaaaaagtacaatagtaaggctcctatcatgctatcttcttctattcaggcaaccttaattgggcgctatgctgggggagaatatgggaaaagcaagctggcaggagaggaattattctttcaacatgggcaggaacagggagtaaaagtagcagtttaccgtttcccaaatttgatggggcattccagacccaattataattcagctgtatcaacattttgttgggcgattgccaatgatcaaccttattctgtttcagatcctaaggcggaagtcgaactgctctacatttatgatttagtagatggtatgttggatttgttggagggcaaggaagtttattgtaactatgaggggttaactccagttgaggatgctgatggcaaatatgcttggattcaaaccactcatcgtgtcaccttgggagaaattattgctctcttggaatccttcaagcaacaaccgttgaccttgatgatgcccaagattccagctaactcttttgcgaagaaattattttcactctatttgacttacttgccgacagaaaagttcaagtatggtctaaaaatgaatgtggatgacagaggttctttcacggagttgttacacacagctgattgtggtcaggttagtatcaatattagcaagcctggtattaccaagggtcaacattggcacagcagcaagtgggagcaatttatagtagttagtggcagaggtctcattcagcagagaaatattgtcacgggtgaatttgtggaatttgaagtgtccggagataccattgaatctatctatatgattcctggttggactcataatattattaatctttcggatacagaaaatttagtcacggtcatgacctgcaatgagatttttgatccgaatcgaccagataccttttttgaagaagtttaataaagtgacagttttcttgaatatatagtaaaattctcctaattatggaacataactacgattaataatttctatgtggtttttggaatagttcttttacaactctttatcaagaatgatatgttttagtagtccggaatgttttcagaataagtattgaagagtcagctagaatgtgagggttaattgtattttttgaagttttactataatcacaattgttatttttaatggattcattttatatcttagataggcaagggttgtggagatattttaagagtagtactgataaatggttaataatggttgcatatttcgtaaccgctcaacggagtatattgaaaaacgttccaaagcataagactctggaacgtttttttatgttgcaacgtaactgcgtaataaggtaaccgcctaataacaaggtatctatctaatcactccctcctccagtatactgttataaaaaacaaaactggaggattttttatatcacaccccatcgtcccattgactgttccccaatcttgccattttgagaagaaaggcagaaatgatattctgatgaaaattcgtctcggaaaagtggaagtcacattctttcactctatcaaccaagaaatattagaaacaatcttggataaggtactgttctatgacaatccggctcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacactttgttctttaagatgatcatcgtttttcacaccggtaaataggtaactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtaacccagttgataaaagtagtgagataaggagtagatttcgcatagctttccgcttagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggccccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagctattatatacgataatttatcaatttattatcattagtataccataatctacattttttttatagattttattaaaatttttatagtaaacccgtggtgctagttcatttcaaaatacaataaaaagcccaaatggactatactgtaagtgacgaaacatacaggaggttagtccaaatgagccacttacagtataccgctaaatctcatcatttgcaatggaatgtacgccaattatcacaaatttgtcatcacttctaccacaactattgcccggattccttcaaatatcggcgaaatgttggcttagttaaagtttcagatgaatcactccttgtcttgcttttgatacaagcagaactaggcataacatcacaacgccattcctacaccatctgccacctcttcccttgcggtcagttactagaaagaagccgtttcaatcgtcggtcaaaacaattgatttggctagtccaattaatccgaaaagctatgagtgaaatgcttccatctgataaactagccattatagatagttttcctttgccactttgccaacctgttcgcaatcacagagttaccatttttaaaggattagcagatattggctacaacgcctctaaacatctttggttctacggcttcaaggttcatatgctagtgaccttatctggttatattttgaactatgttgtcacgccagcctctgtccatgatatcaaggtggtttatgagctattagaggggtgtaagcaatcggttatcttaggtgatctaggctacctaagcagtgagctcaaaaaggacttagagtaagaaggttaccatctatggacgccgtttcgtaaaaacatgactgggtccgaagaacataacaattggaaagtaatggccatgagacgaactattgaaacatgtttttctgaactgtgtcgtctctttgacatcgaacatacattaactagagggatagccggactacagttacgaatggaacaaattattctagctcataacttacgctattttgaaatgaactagcaccacgggtatagtaaatatttttagttttttgtttcaaaaatgtaatggagattgatttttcacaagtaattgtcataaaaatcagaaaatattttataaatatgataaaatgaaagtgatactagtttgaggtaaggatatgaaattaagaagaagcgtagaaaaactaaagggaacgattcgtgtcccaggagataaatcaattagtcatcgctctattatttttggttcccttgcaaaaggtgttactcgtgtccacgatattttgcgtggggaagatgtcttgtcaaccatgcaggtctttcgtgatttgggtgtaaaaattgaagacaacggtgacattgttgaagtacacggtgttggttttgatggtcttcaagcaccaaaaaatgatttggatatgggaaattctggaacctcgattcgtttgatttcaggcgttttggcaggtcaagactttgaggcgactatgtttggtgatgattccttgtccaaacgtcccatggaccgagtgactattccactcagtcaaatgggagtagagatttctggacaaactgaacgtgatctacctccgttgaccatcaaagggaataagaatttaaaaccaattcgctaccaactccctgtagcctctgcccaagtaaaatcagctctgatttttgctgccttgcaggctgagggagagtcggtcatcgtagaaaaagagttgactcgaaaccatacagaagatatgattgtccagtttggtggacagttagaagtcaatggcaaggaaatccgcatccaaggtggtcaggagtttattgcccaagagattacagttccaggagatatttcaagtgctgccttttggttggttgctggcttaatcgtaccaggttcaaaaattgtccttgaaaatgtgggaatcaatgaaactcggactggtattctagatgtcattaaagctatgggcggaaaaatgaccctttctaacatagatgaacttgcaaaatctgctaccattacagttgaaacgtcggaattgaaggctacggagattgcaggcgaattgattcctcgtttgattgatgagttgccaattattaccttactagcgactcaagcacatggaacaacgattattcgtgatgctgaggagttgaaagtcaaagaaacggatcgtattcaggttgttgcagatgctctaaatagtatgggagcaactattgaaccaacagaagatggtatgattattcacggaccaactgctttacatggtgctgaaatcaatacatttggtgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaacagcacatttgttaaatctccccgtttatgatatggaccatatcattgaagaacggattggtatgcctattgctgactatttcagtcttgaaggagaggcttcgtttagacaactggagacagaggtactgaaagaattgctggacttacctagtaattgtatcgtgtcaactggtggtggggtgattaaatctgaagtaaacagggaattgctgttggcaaatagggaggacaatgtacttcttactgcctcctttgacgtttcctatcagagaattcgtaaggatagacagtcgcaaagacctctctttttacagtgtagtaaggaagagtttgaagccctctatcgtgaacgaatggcactttatcaaggtttagctgatactgtaatcgatacagataaactgaatccagaacaagtagcaaggaaaattttatgcaagtagcctatctaggacctcgtggttcttttacacatcaagtggcccagcaagcctttccgactgcggatttgcaggcttttgaaacgattacagaggttatcaaggcctacgaaacgggggaagttacctattccgttattccagtagagaactcgattgaaggtagtgttcatgaaacgattgactatctctttcatcaggcggagattcatgcggttgcagagattgttcaaccgattgcccaacaactgttagccacgagtgccgataaggctgtagaggttatctattctcatccgcaggcaattgctcaggggaagaaatatattcaggaacattttcctcaggctcgtattgaaataacagctagtacagcctatgctgctcgctttgtggcagaacaccctgaacaaccattcgcggcaattgctccgcaagcggcagcagttgaatatggactggaagtaattgcgcaagacatccaggaaatcagcgagaattttacacgtttttggattttgggggataaagttccgtctattgccctggaacaagtagctaaaaaagtcagtcttgcactgacattgccagataacctgccaggagccttgtataaggccatgtctgttttctcatggagaggaatcagcttaacaaaaatagaaagccgacccctgaaaacggttttgggtgaatattttttcatactggatcttgacaatcagtctgaggaattattagcctattctcaaaaagaattgactagtttagatataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgcgagttggactatctattatataaaaaagagctgagagaacggcatggaagtccaaggcaatctctacgtagcttcacaccaacggcttatgaagatgacttcgaggaagattattttgaagaggatgatgagcaagaggaactgttgcctcgctatcctgaacgtaaatctagaaaaacaagacaagccaaacctcaacggtttcagtctcctcgtatcgagcccaaagcgaaagtacctaaacctaaaaaagctcgtaaaaagggtggtttcaagcgctttattggtttcgtattgcttgctatagcgctagtgattgtagcgatgggctatagttttttcaaaggtatgaatagcgtgagtgagaagccagtagctgaggtctttaacggcgtagatacatcgaatgggacaaatattttaattttgggaacagacggtcgtgttggcgaaagctcaggtgaaactcgaacggataccatcatggttctaaatgtgaataacacggataacaaagtcaaacttgttagctttatgcgggataccttggtggatattgagggatatgaatataaactcaatactgcctatactttgggagaacaggataatcagcaaggggctgaagaagttcggaaggcgttgaagaataattttgacattgatattaagtactatgcgatggtggattttgcaacctttgcgacaacgattgatatacttttccctgagggcgtaacgattgatgcacagttttcaactattaatggtgaagtcgttagctcagtagaagtgccgaatgatttacagctggaagaaaatgctcctgcttatcaaacgattcaagtcggtgtacagcagatggatggtaagaccttgcttaactacgcgcgctatcgttcggatgatgaaggtgattttggtcgtacgagacgtcaacaggaagtgttatctgctgttatgacacaggctaaaaatccaatgaaactattctctggctccgaagctataggtaaggttgtggccatgactccgacaacagtgccacaaagctttatgtggctacagggaccaggccttctattagatgcggcaaatggtatcgaacgtgttacaatcccagaaaatggagactggattgacgactatgatatgtatggtggcatggctcttcgtgttgattttgaaaaataccagcagcgcttggctgagttaggcctgcgttaagaaatatggtatactagaagtgacttcggtcacttttttagtggttcaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcaccagaccgtaatcaggacttggatttgacctatctaagaacaggtattgctgacttggggcatctcacttatccagcccaactagcttttaagaaaaaacaagtagagaatagtctacgtaagattgcaggcatttcagaaatagcagtagcagatacgttgggaatggacaatcctcttgcttatcgtaataaggcagctgttccagttcgtcgtgtgaatgggcagttagaaataggatttttccgaaaaaattcacatgatttagttccgattgaggatttttacattcaacataaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaaaattttccgtgttgaaacccttattgagcgtctgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaaaggctgtccttgatagtcagaagaatgctgctcgaaatgggattgataatgttacctatgtctgtgatagtgcagaatccgctatgcaaaaatgggtggcagatggagtcaaaccaactgtgatttttgttgacccaccacgaaaaggtttgacagaaagttttatcaaagcaagtacttctgtaaaaccagagaaaatcgtctatatctcctgtaatgtagcaaccatggcgcgtgatattaaactttatgaggaattggggtacaaattgacgaaggtacagccgactgatttatttccaaatacgcatcacatagaagttgtgggattattagaaaaacgcaattagattgtccagcttactctcttgttttctggcaagctgcttcaaaggtccgcaggacctttgaactctcaaatacgcatcatgttgacagttgccacatctacaccaaaatcaaatgccaacaagcgttgagtcgggtaatagcgtaagtagcgcaaggtcatgataagctgctcttccatacttagacggcgtggatgtcctccttttcggtgttgctcttgataagcgtcagtgagacaatcaagcatcagttgaaacgtcgctttttttaacaactatcaacaatttgaaattctctgagtttaattttaaggctttttcgtatgttgtttccatacctttagtataccacttttgagttaccgaacaaatctattgctaaacttgatgaaggttgtattgtccgttataatattggatattgcaagctttaagtgaaaggttttagggaagagattatcacaactcattctttattggttatgagacgatggtataaatgatagtctagtaaaagatttggagaaatgacttccctagaaggttaaatgtaaaaacaatatgaaaaaacacgattatttagttgttggtgcagggctgttcggtgcggtctttgctcatgaggcagctaaaaagggtaaaaaaataaaggttatcgaaaaacgagaccacattgcaggtaacatctatacaaaagaagtcgaaggtattcaagtccatgaatatggcgcacatattttccatacttctgaaaaagaaatttgggattatgtgaatcagtttgcggagttcaaccgctatacaaacacaccagtcgccaactacaagggtgagatttacaatcttcccttcaacatgaataccttttacaagctttggggcgtggtgacccctgctgaggcagcagcgaagattgctgagcaacgggctgtattgggaggaaaaacacctgagaacttggaagaacaagccgtctcactagttggtacagacatctatgaaaaattgatcaagtcctacaccgagaaacaatgggaaaaaccatgtacggagttaccagccttcatcatccgtcgtttgcccgtgcgtttgacttatgataataactattttaacgatacttatcaaggtattccaatcggcggttacacgcagattgtagaaaaaatgttggaacatgaaaatatcgatgtggagacaaatgttgatttctttgccaataaggaagactatttagcgacctatccgaagattgtatttacaggaatgattgatgaattctttgattaccaacttggtgaattggaatatcgtagccttcgatttgagacagaagtgttggatatggaaaactatcaagggaatgcggttgtcaattacacagatagcgaaacaccgtttactcgaatcatagaacacaaacatttcgaatttggtacacaaccgaaaaccattattacacgtgagtattcgaagacttggaaacgaggtgatgagccgtattatccagtcaacaatgatcgcaataatcatctatacacagcatataagaaattggcagaacaacaagagaatgttatattcggcgggcgtctgggtcattatcgttactacgatatgcaccaagtcatcggagctgccttacagtgtgtgagaaatgaagttggggaatgattttgagaagtcatcaaagtagtaattgattcttggcagaagttggaatgctctctaaatgttaatcaaaaaaaccagaaattctggtttttttgattattattgaattgctgccaacaggtcagctgcttgttgttcgagttttgttagagtttcgtcagataactctaatacacctgttccccatgcttctggattgatggttgaacctgtaaattcaccagcaatctgagtacggataaatggaagaaggtgttggaagtctttgaataggtggtcgtgaccactgtttgcgacggcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaagaacgcttcagctttttttgccatttgatggttaaaagaaccgtcacgtagtgaaccaactaaaaacaatacgtttgccatgatggcctccttttcataaaaacataaatttagtatattgtatttgtcttttgttggcaatcctaggtctgctggttcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgacagtcttgtagatataaccatctcgaatcatgttttttataacgacagtcatgttgccagaagtacttaataatttatcaattaagtcttgaatccgcagatttcctttgttgtagagtgcctccatcactccaaactgacaaactgtcagtccgtattttttgattgtttctaattctgattttgtgatagaattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtacttttatggaaaagatagtttttagttaatcaagttcgttttttgaggtaatactaactgtactggaaaaaacgagcaatgagcatttgagaaatagtcttagatggaagtgcaaaactgtgaatgtaggtttttatatccttttctttgtgcgaaggaaaaggaaattttatttacaatcacggaaagaatggaaatatactttaatttgtagtataatgggactactatggaaaaaaagatttttcaactgttggagtggatggcttccaagactggtcagttagtgttgggctcttctatccttctcagtgttgtgactttttcaatttttactatttgggatattgctgctgcccctttcaacaatgcgcgtagtcatgcagttgcagtagctacagaatatgctgatttgcaaactgtcaatgatttttctatctacaatggtactgaaacctatttttgtgtatttggtgtcaccagtcagagagaagaggttgcagttttgattccagaggcttctagcacagtatatgtctatcctttagctcagggaatttcgcaagaagaagcgcaagctattgccaagaaaaacggtgcaagccaagtagagcgaactattctaggtttaagagatggcaaacctatttgggaagtcaagtcaggtactgcctactatttagttgaatttgaaacagggaactttatcaaacgggagggcttatgagcaagttatcaagacgagtcttagagatggaagaaagtgtaactctggcagcaggtgcgcgtgcaaaagccttgaaggcagaaggacgtgatattttagagctgaccttgggtgagccagacttcgtcacaccgaaaaatattcaagaagctgctattaagtctatcgaagatggtaaggcgagtttttatacggtagcttcagggcttcctgagttgaaggacgcagtcaatacctactttgaaaatttctatggttactctatcgaacgcaatcaagtcgttcttgccacaggtgccaaatttgttctctatgctttctttgcggcggtcatcaatcctggcgatgaggttctgattccgacaccttactgggtttcctatgcagatcaaattaagatgaatgatggggtgcctgtctttgtcactgcaagggaagagcacaatttcaaggtaacggttgaccagctggaagcagctcggacagataagaccaaggtgctcttgctcaacagcccgtccaatccgacaggtatgatttacagtcgtgaggaattggaagctattggaaactgggctgtagagcacgatattctcatcttggcagacgatatttatggtcgtttggtctataatggaaataccttcacaccgatttcaagtatttcagaaagcattcgccagcagactattgtggtcaatggtgtggcaaaagcctatgctatgacagggtggcgggttggctttgccgttggtaatcctgagattattgcggccatgagtaagattgtcggacaaacgacgtcaaacttaacaaccgctgctcagtatgcggccattgaagcctttacaggtccgcaagatacagtagaaaccatgcgtcaggcctttgaagagcgactcaataccatttatcccttgctggcagaagtaccaggttttgaggttatcaagccagaaggagccttctatctcttcccaaatgtcaaaaaggctatggaaatgaagggctacacagatgtgaccgaatttaccacagctatcttggaagaagtaggagtagccttggtgacaggtgctggttttggagctcctgaaaatatccgcctcagctatgcgacagatatggacacgctcaaagaagcagtggctcgactacacacatttatgaaaaaataaaaagaggaaaaataatgtctagaaaattgattaccatcaaccaagtaaaagattatgtcggtcaagaagtgaccattggtgcctgggttgccaacaaatcaggcaagggcaagttagccttcctgcaattgcgtgacggaacagccttcttccaagcagttgctttcaagccaaacttcatcgaaaaattcggtgaagaagctggtactgagaagttcgatgtagcaaaacgtctcagtcaagaaacgtctgtctatgtgacagggattgtcaaggaagacgagcgttctaagtttggttatgagctagatgtgacagaccttgaagtaatcggtgagtcacaagattacccaatcacaccaaaagaacacggtacggacttcctcatggacaaccgtcatctctggttacgttctcgtaaacaggtcgctatccagcaaatccgtaacgccatcatctatgcgacttatgaattctttgaaaagaatggctttatcaagtttgatagcccaatcttgtctggaaatgcggcagaagattcaacagaattgtttgaaacagactactttggtcaaccagcttatctcagtcaatcaggtcagctttatcttgaagctggtgctatggcacttggtcgtgttttcgacttcggacctgttttccgtgcggaaaaatcaaaaactcgccgtcacttgacggagttctggatgatggatgctgagtattcattcctcagccatgaagagtcacttgacttgcaagaagcttatgtcaaagccttgattcaaggagttatcgaccgtgctccacaagccttggaaactcttgagcgtgatgtggatgctctcaaacgctacattgcagagccattcaaacgtgtggcttatgatgatgccattacccttcttcaagagcatgaagctgatgaagatacagactacgaacacatcgagcatggtgatgactttggatcgccacatgaaacttggatttcaaactactttggtgtaccgactttcgttgttaactatccagcaagcttcaaggccttctacatgaaaccagttcctggcaatccagagcgcgtgctttgtgcggacctcttggcgccagaaggctacggtgaaatcatcggtggttctatgcgtgaggataactacgatgctttggtagctaagatggatgaactcggcatggacaagtcagaatacgaattctaccttgaccttcgtaaatacggttcagtaccacacggtggttttggtatcggtattgagcgtatggtaaccttcgtcgctggtacaaaacacatccgtgaagccattccgttcccgagaatgttgcaccgcttgcatccataagcaaatcaatagg

SEQ ID NO: 62 - DNA, 29624 bp, Streptococcus suis
cttaatgacattggacttttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcatgccatttctttttaaggttgctggaagtccgttcgtaataaatctctaaaatttcttcttttgacttataattgcgatagaaagcgttgcgagaaactcccgctttacgaaccaattcagatactgaaatttgcttgagctcctttttctctaggagaaatagcagagcagtttctattgattccttagtcagttgattcgcttctttatttgattgatagaggtttttcaaagattggggtgaaattttacgacctgtcatagttttccttttccgagtgtcacatctgaaagaaaatgctttcagatggggtagtttaatgatataattgtaagtaaatagagatttattgtcaaataaaaaagtaaaattggaaatgagaatattatgacaaaatggaaaattgttgcagattcgggctgtgactatcgtcaattagctaatctagctccgaacactgaatttattagtgtgccacttaccatccaagttggagaacaagcatttgttgatgatgcaagcttggatattgatcacatgatggaggtgatggaagcatctaagtctgcagcggggtctgcgtgcccaagtccgcaggcttatcaggcagcttttgagggagctgagaacattatcgttgtgacgattacaggtgggctatcgggtagttttaatgcggcacgtgtagctagggatatgtatatcgaagagcatccgaatgtcaatatccatttgatagatagtttgtcagccagtggggaaatggatttacttgttgacgaaatcaatcgcttaattggtgcaggattagattttccacaagtagtagaagcgataactcattatcgggaacacagtaagctcctctttgttttagcgaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaatactcaatgaaaatcaacagtagcctaggaaacgaagtcgaagatagaactctgttactatcttatttcaaggtaacaggctgaaaacctccactggagcttttcactcatcaaggcaagttgacaacggataattttgattttcgaagagtataacaattttggaatgtagtttccactatatagaataatccccctcgtctcttaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggagaaagaatccccttgcttagctgaaaggtcacgctccctttggaaattcgatacgggatgttcaaagcgtatttctctaaacaatcttttattttattccactgagcgtgataaatgtgatgaagatgctgtgtgttccgtgcaaacataccgttatcaatgtagagcgagagagctttttgcatgataagattggtatcgtagtcgattagacttttatgtttgatgaaggtatcatgtagctgattaggaaggctgattgcaccgattcggagggcaggaaagagcatcggtgtaaaagattttatgtagatgacacgattatctgtatcaagatagtgtaaaggtaggctatgactagagtcgaaatccgccaaatagtcatcctcaatgatgtagacatcgtattgctttgctaattttacgatagctgtttttgttgctatatcataggttgaaccgagagggttgtgcaagcgaggaattgtgtagaaaaacttgatttttccagtttggaagatactttccaattcttctaggtcaattccatctaaatcccgttcaattgtttgataggggattccttgatgtcgaatgagctctatcattcgtgaataggtagggttctctatcaagatttccgtttttccagcccaggtttccatttgtgtgagaatatatagagcttgttgactaccagctgtgataaccagctggtctttttttgtatagacatgatagtccattaacagactttgaacggaggaaatcaattctgctaatccctcttgctggtgatagtagttgaataggtaattttcccgcccaataagactttcgtttagacaaatccgaaaatcttcatagggtaattcttgaaagtctgcaggattgagctctacagtatggtcttggaaatctctatcttctaagatataataaccgcttttttcgacagcgtagatcttattttggtactttaattccaacatagccttttggacagtgtctttgctacaatgatattgctcactgagttgacggatagaaggtaatttctctccacgtttgaatcggtgttcctctattccagtcaaaatatcttggataataacttgatattttttcatctaggccccctttttatagactatgttactagctagtatataggaaaaattgaagaaagacaatatctggatggggttgaggttcaggaattaagctactatatggtataattaagtgatgaaaataattatacctaatgcaaaagaagtaaatacaaatttagagaatgcctcgttttatcccctgcctgatcgaagtaagccggtactggatgccataagtcaatttgatgtaaaaaagctggctgccttttataaattgaatgaatcaaaggctgagttagaagctgatcgttggcatcgaatcaggacaggtcaagcaaaaacctatccagcctggcagttatatgatggtctcatgtatcgttatatggataggcgaggtatagattcgaaagaagaaaattacctacgtgaccatgttcgtgtagcgacagccttatacggattgattcatccttttgagttcatttcacctcaccgcttagattttcaagggagcttaaagataggcaatcagtctttgaaacagtactggcgaccgtattatgaccaagaagttggtgatgatgaactgattttctcactggcttcgtcagaatttgagcaggtgttttctccacagattcagaaaagattagttaaaattcttttcgtggaagaaaaagcaggtcagctaaaagttcactcgactatatcaaaaaaaggtagaggaagattgctgtcctggttggctaagaacaatattcagaaattatcggacattcaaggttttaaggtggatggctttgaatattgtactgaaaaatcaacagagaatcagctgactttcatacgttcagttaaattatgaaaaaagaacaagataatgtttttcaggttttcaggtaacgtttttcatcactaaatatagctatgtcgctagtaaaagattgttatttgtgatacaataagtaagttataagtaaaaggaaggttgtttatgaagaagagaagcaggtggaggaaatcgcctaagctcaagttggtaaattttgtgctttggggactttatgccattactctatgtttgttcttagtgaccatgtatcgctataacatcctagatttccggtatttaaactatattgtgacgcttttgctagtaggagtggcagtattggctggattattgatgtggcgtaagaaagcgcgcatatttacagcattcttacttattttttcactagtcatcacttccgtcggaatctatggaatgcaagaagttgtaaaattttcaacacggctaaattcaaattcgacattttcagaatatgaaatgagcatccttgtcccagcaaatagtgatattacagacgttcgtcagcttactagtattcttgctccagccgaatacgaccaagataacatcactgctttattggatgacatatccaaaatggaatctactcaactagcaactagccccgcaacctcttacctgacagcatatcaatctatgataaatggtgagagtcaagcgatggtcttcaacggagtttttaccaatattttagaaaatgaggatccagacttctcttcaaaagtgaggaaaatatatagttttaaggtgactcagactgttgatacagctactaagcaggtgagtggagacagttttaatatctatattagtggtattgatacctacggtccaatttcatctgtttcgcgttccgatgtcaatatcattatgactgttaatcgtgcgacacataagattttattgacaactactccacgagattcatacgttgctatcgcagatggcgggcaaaatcaatacgacaaattaactcatgctggtatttatggtgtcaatgcctctgttcatacattagaaaatctttatggtatcgatatcagtaattatatccgtctcaactttacatccttcttgcagttgattgatttagttggtgggattgatgttgaaaatacccaagaatttacaagcggagggtataatttccctgtggggacagtacacctagacgcagagcaagcgctaatctttgttcgtgagcggtattcgttggctaatggtgataatgaccgtggtaaaaaccaagaaaaagtcattgcagccctcataaaaaaattgagttcaccagagaatttacgcaattatcaagctattttaaatagtttagaagattctattcaaacggatataagtattgaaacaattataggcttagtgaatacgcaattagaatcaggaacacaatttacagtggagtcacaagcgctagttggaaatggtcgaacagacttgccttcttatgccatgccggattcacaactttatatgatggaaattaaccaagatagtctggagcaagcaaaggcctcgattcagtcagtattggatggaaattaaaaaaataggagaaaacatgaataatcaagaaatgaatacaatcgaaattgatattttactcttactgaaaacgatttggagaaaaaaattctttatccttctgatgggactattaggtgcagggttagcttttgcttatagtagttttttggtaacaccgcaatataaatcgacaactcgtatctatgtagtcgggcaacatgctgaagccggtgcgggattaacaaatcaggatttacaagctggttcttatttggtaaaagactataaagaaatcattctatcacaagatgtactgacgcagatagctacagagttgaatttgaatgaaaacctaaaagaaaaggtttcggtttctattcctgttgatactcgtatcgtttctatttccgtgcgtgatgcggatccaaatgaggcagcacgtattgcaaatagccttcgtacctttgcagcgcaaaagattgttgaggtcaccaaagtgagtgaagtgacaacactcgaggaggctgtcccagcagaggagccatcaactcctaatacaaaacgaaatatcatacttggtttattagctggtggtatcttggcaacagctcttgtactggttatggaaattttggatgatcgtgtaaaacgtcctcaggatatcgaagaggtaatgggattgacattacttggtgtagtgccagattcgaagaaattgaaataggagaacaatatggcaacgttagaaattgcacgtacgaagaaagaattagtaaataagacagaagaatattttaacgctatccgtacgaatattcaactcagtggggaagatattaaagtggttggtataacttctgtccaatcaaatgaaggaaagagtacaatagcagccagtcttgctattgcctatgctcgttctggctacaagacagttctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttctacaaagtaagaattttgagaacttattagctactcttcgtcggtattttgactatgtggttgtagattgtccacctctagggatggtaattgatgctgcaattattgctcagaagtgtgatgcaatggttttagtagcagaggcaggacatgttaaacgttcagctgtgaaaaaagtaaaggaacagttggagcaaacaggaacacagtttttaggcgttatcttgaacaagtatgatattgcaactgagaaatatggtgattatggaaattatggtaattacggtaaaaaagcttgatttttatgatatgagctttgattaagtaggtgttagtatgattgatgttcattcgcatattatatttggtgtggatgatggtccaaagacaattgaagagagcctgagtttgataggcgaagcttatcgtcaaggtgttcgctatatcgtggcgacatctcatagacgaaaagggctgtttgaaacaccagaaaaagttatcatgactaattttcttcaacttaaagaagcagtagcagaagtttatcctgaaatacgattgtgctatggtgctgaattgtattatagtaaagatctcttaagcaaacttgaaaaaaagaaagtaccaacgcttaatggctcgcgctatattcttttggaattcagtatgaatactccctggaaagagattcaagaagcagtgaacgaagtgacgctacttgggctaactcccgtacttgcccatatagaacgatatgatgccctagcgtttcatgcagggagagtagaagagttaattgacaagggatgctatactcaggtaaatagtaaccatgtgctgaagcccgctttaattggcgatcaagcaaaagaatttaaaaaacgtactcgatattttttagagcaggatttagtacattgtgttgctagcgatatgcataatttatctagtagacctccgtttatgagggaggcttataagttaataacagaggaatttagcaaagataaagcgaaagcgttgttgaaaaagaatcctcttatgctattaaaaaaccaggcaatttaagctggttaatctagattttggagaaaaaatggatttgggaactgttactgacaaactgttagatcgcaacagtaaacgattgatactcatgtgcatggatatgtgtcttattataatttccatgattttgagcaggctgtttttggatgttattattgacattccagatgaacgctttattcttgcagttttatttgttttaatattctatatgattatctcaattagactaaaggttttttcgctaattacgaggtatactggatatcaaagttatgtgaaaataggactgagtttgatatccgcttattcattatttttaattatctcaacgattttatggcagacctttagttatcgtttcatcttagtatccttatttttgtcgtatgtgatgctcattaccccgaggattgtttggagaatcttacatgagacgagaaaaaatgtcattcgaaagaaggttagtccactaagaatcttagtagtaggtgctggagatggtgggaatacttttatcaataccgtcgaagatagaaaattgaattttgaaattgtcggtatagttgatcgtgatccaaataaacttggaacatttatccgtaccgctaaagttttaggaaaccgtaatgatattccacgattggtagaggaattagccgttgaccaagtgacgattgccatcccttctttaaacggtaaggagcgagagaagattgttgaaatctgtaacactacaggagtgaccgtcaataatatgccgagcattgaagacattatggcggggaacatgtctgtcagtgcctttcaggaaattgacgtagcagaccttcttggtcgaccagaggttgttttgaatcaggatgaattgaatcagtttttcaaagggaaaacaatccttgtcacaggagcaggtggctctatcggttcagagttatgtcgtcaaattgctaagtttacgcctcaacgattgttgttgcttggacatggggaaaattcaatttacctcattcatcgagagttactggagaaatatcgaggtaagattgagtttgtccctctcatcgcagatattcaagacagagagttgatttttagtataatgtctgagcatcaacctgatgttgtttatcatgctgcagcacataagcatgttcctttgatggaatataatccacatgaagcagtgaagaataatatttttggaacgaagaatgtggctgaggcggctaaaactgcaaaggttgcaaagtttgttatggtttcaacagataaggctgttaatccgccaaatgtcatgggagcgactaagcgtgttgcagaaatgattgttacaggtttaaatgagccaggccagactcaatttgcggcagttcgttttgggaatgttctaggtagtcgtggaagtgttgttccgctattcaaagagcaaataaaaaaaggtggacccgttacggttacagactttaggatgattcgttatttcatgacaatcccagaagcaagtcgtttggttatccaagctggacatttggcaaaaggcggagaaatctttgtcttggatatgggtgagcctgtacaaattttggaattggcaagaaaagttattctgctgagtggtcatactgaggaagaaattggaattgttgaatcaggtattcgtcctggggaaaaactctacgaggaattactatcaacagaagaacgtatcagcgaacagatttatgaaaaaatatttgtaggtcgcgttacaaataaacaatcggacattgtcaattcatttatcaatggattactcaaaaaagatagaaatgaattaaaagataagttgattgaatttgcaaaacaagaataagaaagtaaaaaaatatttttactttcctagagtttaaatgagatttaaattctaggaaggttgaaaaactttccagaggtaagatatgctaggtcataggttagtaagagaaaaagaaaataggatcaaaggtggtctttaccataagattcaaatcgagctggctttcaactcaaaccacattgaaggcagtcaattaacctatgaccagacaaggtatatctatgagaccaatacgattggttttgaagaaaattcaaccataaaggtggatgatattatcgaaacgaccaatcattttacggctgtcgattttttattagatagctttcaagatgatttgaatgaaacttggataaaggagattcatgctatcttgaagagaggcacctctgattctcggaagtcatggtttcaagtcggagactataagtcgtacccaaatgaagtcggcggtcgtgaaacgactctgcccgagtatgtggagtcagatatacaagaattgcttagaaactatcatgctctgtcgcctacttcctttgaggatattcttgcctttcatgttcgatttgaatgcatctatcccttccaagatggtaacgggcgagtaggtcgattgattctgttcaaagaatgtctcaaacacggacatgtcccctttatcatcggagatgacatgaagtatttttactatcgtggcttagccgagtggggtgagcagaatggtttcttgctggatacttgtctagcagcacaagatagatttaagcagtatttggagtattttaggattgaggattaggagagggagatgtatccgatttttaaacgagtttttgacattgtgctatcaggagtggctatcttttttttcagcccaattttagtcattattgcgattgcaatcaagctagactctaagggaccagtactatttaagcaaaaaagagttggaaagaataagacatatttcatgatttataaattccgctctatgtatgtagatgctccaagcgatatgccgacccatcttttgaaggatcctacagcgatgattacaaaagtaggagcttttctacgaaagactagtctcgatgaattacctcagctattcaatattttcaaaggagaaatggccattgttggtccacgtccagccctatggaatcaatacgatttgattgaggagcgagataaatatagagcaaatgacattcgtccaggtctgactggttgggctcaaattaatggccgtgatgagttagagattgatgaaaagtcaaaattagacggctactatgttgagaatatggggcttctgcttgatattaagtgtttttttggaacttttattagtgtagcaaagagtgaaggcgtcgtcgaaggcggaacggggcaaagggagagataaggtgaaaaaaattctcattacaggagcagggagctatataggagagagttttcaaagatttggtgaggagcatacagattttgtcattgcggaattagatgtgaaaaattcaaattggacaaaatttgatttttccacttatgatgtagtagttcatgtcgcaggaattgcgcatattaatgaaaaaaagatttctgaaaaaatatatgatgaggttaatcgaaaattagcactagatgttgcgactatagcaaaaaaatctggtgtagggcatttcatttttatgagttcaatgagcgtctatggcctcaatacaggacacattacaggtaatactattccgaatccaaatactaaatatggtatatcaaaatggaaagccgagctagaactacttaagttgacttcagaagatttcatactgtcaattattagacctccaatggtatacggtaaagaaagtcggggtaatttttctaaattgcttaaattggttcagcgtgtatctatttttccaaaaattcagaatcagagaagtatgattcatattgttaatttatcaaattttatttcgcttgttattcagaataaaataaacggaattttatttccgcagaatacagaatatgtatctacggtagagatggtcgaaataatttcaaatgttctagggaaatcgatttactttgtaaaactgcctcttaacagttctttgctcaatagagtcccgattgtaaataaggtgtttggttcattaacctacgataaatcgatgtcctctattcaatcttcaagtggaaaaaatattgattattgcttacgaaattttaaggatagtttgagggagtctgtgctttgaaaaaagatattttattcttgtgccaatatttctatcccgagtatgttacttctgctcttctaccgtatcagacagcaaaagagctggtagataataatataagtgtagatgtactgtgtggttatccgaaagaataccattcaaaaaataattcaactgttccaaagatagaagtagcagatggaataactattaagcgtgttaattatttacaattagacaggggaaacgccttatttagattaataaattatttttcattcgttttttcttgctttttaagattcgcaacccttagaaagtataagctgatttatgtatattcaaatccgccaatactacccttacttacagtgttagctaatatgctcttcaagacaaaatttgtttttgtagcttatgacatatatccagatattgcaattaaaacaaatatactatctgagaaaaatcctattagtttaataaccaatttaatcagcgcacaagtatttcgtagagcagaaaagattgtagcattgtcaaaagaaatgaaagagtaccttgttacacaaaaacaagtagatgaagacaaaatacaggttatacctaattgggctactgagaaagaaagggaagttttaccaaaggataatccttctgaagaaatcataatatcgtatcttggaaatatgggaattcctcaggattttgataggattgaagaaattatttcaaatgaagtcatcaggactttaccgattcaatttatatttgctggacatggaagtcgcaaagataagctgaaagaatttgtagtgtctaataaattatctaatgtcaaagtgcacgattatcttcaaggacaagattatgatgagattctgcaaaaatcagactatcacatgctttcactaaattctgatttacaaggtttagcggttcctagcaagttttattcctatattaacaatgaaaaaccagtaattgcacttatacatgagggtagcgatattgcgaaagatattcaacgctatgacttaggttatgtcattgcaaggggtgagttgatggctgcggttgaagtcttcacaaaacttgttcagagtgagaaggtacataaagtaaaacaacataaggtacatttctcgaaagaaatccaactaagaaagtatgttgaactgacactagaaatgttagttaaggaaaagaaagtttaaaaaaagtttctatttgactattggtaggataaattcgttaactagccgaagctactccttacggtggcattccttgcttaaaaaggggggctatgatgagtatcggggaatctataataacaagaatttccgatttagtttaattaagtagaagtagagctgtgtagggtggaacaataatattttgaatatcctcaagtgaagaagaaccctttgtagcaaatgcgctgcattatagtgtagcgtacttcaatagagaatgtttattggatgaattggagaaatggcattaaagtagtaaatagtttgaagaatagagactaaaattatgaaaattttacagataaatacggtaatctcatatggttctacggggattatttgtcaaaatatagcgcgaggtctgattgcgaacgggcacgattgtttgacggtatatggacgtggaaatgatgttgaagatattcctacaaagaaaattgggaataagtttgagcaaggacttcattatttacgtagtcattttttggatcaacatgggttaggttctcgttttgcaacacggcagttaatacaaattatcagagattaccaaccagatgttattcatttgcataatattcacggttattatgtaaactataggattttatttgaagaattgcgtgcattggctattccagttgtttggttattacatgatcaatgggcaatttctggaggtgctgcctatattgagaataatatccggattgtggatggaaagcctataaagatcgttagaacacaagaagaaaagaagcagtacccatctgtagcacgaatatcatttagtcgttttgaacaaaatattcgtgataaatatcaggttattactgcaatgactaatttgactcttgtaacaccttcttgttggttgactcgctttgttgaagattcatttcttaaaaaatttcaggtgttgactatctacaatggtatggatacaagacagtttagcgttgatttacccagtaaaacagaaaaaatcaatattttaggagctgccagtgtttgggatgaaagaaaaggattgaaatatttttgtcagctagctgaagaccttggtgataattttcagattacactgataggtgtcgatgatagcacgtcactgccatccaatattataaaagttggtagactaaacagttctcagatggttcactattataatcaagcggatgtatttgtaaatccgactttgcgcgataactttccgacggttaatattgaagctcagctatgtggaacaccagttatcacctttgatactggaggagcgaaagaagcgatatgcactcagactgggaagatagttgttcaaggggattatgaacagttgtttgttgcaattacctcgatgattcctaaaaataaatatatagcaacgaagacaagggagcatacattggcgtttagtgtggagaatatggttaatgattatataaaattataccaagaggtcgttgtttgtaaattatagaggagatagtgagaaatggagaaaaaaatagggaatgttctgtttttaacaaatgttccttccccttatcgagtacgcttttttgatgaattaggaaaacattgtaatttgacagtgttatatcaaaagaaagcctcgtctgaaagaaatgaaaaatgggttgagaaagaagaagggcattatcgtagtgtctttctgaccggaatatctactggagttgataatgcattttgtccaagcgtagtgaggtacctaaacaaaacttttgaccatataatcatttgtggaatttcttcgcctactgaaatctttgcaatattgtggtgtcaatttagaggaataccctactatatcgagggggatggggcttttgtgaatgacgggaatacaatcaaaggaaaattattgtcaatttttaaaaaagctcttattaagccaagtataatcaatttttcaacttgcatagagcatgataaatattatttatgttatggttctcataaatcaaggatagctaggtatagattctcttctatttcttccaatgagattttaaaaaatccaattgatttgacatctaaacaaaacttaagaaataaattgggagtgacagaaaaaaaaactgtcctatatgttgggcaatttatacctagaaaagggctggatattttattgcatgcggcaacacattttaaaaatcaaagtgtggggttttatttgattggtagtgatgtcccaagagagtacctgcttttaaaggctgaacttggtttagacaatatttattttgaatctttcaaaacgaaagatgaactaaaagaatattatctgatgtcggatgtgttcgtcttgcccaccagagaagacatttggggcttggttgtcaacgaagcgatggctaatggtttaccggttgtaacaactgataggtgcaatgctggcttagagcttattaaagatggaaaaaatggctatattgtatcagtagaaaatagcacgagtttggcaaacgcaataaaacatatacttgccagtgagggaacgggatttgctgcgttagaagtgattagagactatacaattgaaacaatggttgaggatcatattaggattttaaaaaaacatgaggagaagataaatggagatgaatgtatataaaagtagtcaattagaacgggctgtagctactttatatttgtactttcttccgttgcggatgattgcaccgctttcttttttacctaatgtattttcagggatggcagagagttttgattttgtcttccatattattggtctttttctctatcttatctattctcacggtgtgcttagaatcagtacctccaaagaatacaatctattcagttactttttgtttgcaattctgactttgaatctatcatctattatcatggctacttttatacaacttacctatggaaattatgcaggagaaagtgcctattctgggattttaggaatgcttctttacttcactcaatatgctttaatagttgcttataatataagagtattcaatgtgttaactctggaaaaaatacaaaaaattttaagaaaagtatgcctgtttttactcatgttaggctatttccagatttttgtcctaagatttgaagggttcttcagagaacttctaaataccattgattttttagatatattgtggccagaagatacaatgtggaagttgcctttaactagcaaagagggtgcaggtgcgggcgttatttttggtgcctttgtgttgccttatcttcttgctctgtataacaagtatacccataagagatatattattgagttgttgttatgggtgccagtcttaattatgatgaatagtacaagtgcgtatttcatggtaattgctgcccttatagtattcatcttcatagactatcaaacaactcagagacatagctttgttattgccttcgttggctttcttgtgctgatgatcactgtattgagtttagttggaggagcgaatattttatatcgtatcttaccaaatgatatcagctatttgatactagaaaaaacaacagacttaacaaatggctccactgtttctcgtttagttccgattgtcaccaactggaatatctttttgaattttccattgcttggtgtaggaaatgggttgcaaggctatttttatacgacatttttccctgaatgggcaatcaatgttacgggtagtgatgttatgacattttatacgatagcccagtcaacaattgtcaatggaggactattcttccctagtctcttatcagggtatggtattgtaggattcataatattcattggtcttgtcaaacgtataataaataaaataaattcgcaagacataagtgacgatttctttattgttttctataaaattgctgtatttgcgataattataggaggttttcaagtggactttgttggggattatgtcacgtggtttgtattgagtgttccatttttttacagaaaacggatagggaatgaatctttataaaaataaaagatacataatgctgtgacactatattttaatattaccttgaataacatattgtatgtgagggaaagaaaagtatgaaaaaaagagaaaagaaaaaaatattggtagttatggactcgtatccaccaacatcatctccaaatgatatttgcatggacaacgttatccaggagttaaagataaattatacagtattttgtttagtcaaaaaaaaaatgggagataaaaaatataaagaggttgatggggtaaatgtaatttcttattctaaaggaccaatagattcgtttatcagttggggattagagcatcagaataaattattgtcaaaaactgcttcaacggctaaatttctattgactcgtgccaatcaattatttacaatacctatttatcctattttttggccattctatcagatacggcttgcatacaaattattaaaggaatgtcgcaaaaataatattcatgcggtaatagcagtttgctttcctccagaaagcttatttgcaggaaggtttgtaaaaaataaaatacgagatttagtatatataccttattttattgatgcctattcttgcgggacatatccaaaatatatttcctatgaatttgcattttcaagaaaattgggctatgaaaaatggttaacagataatgcggatgaagtaattatgatggagtctagtcaaagctttcatcaaaaattcagtcttcaacaaattgaacgctacacttttctaaatcccccctttttaaaagaacacgatgttgaagtagtggatttccatcctttattagaagaagggaagataaatatagtatacacagggtacttgtacttaccagatcgtgatccctcgtatatcattgatttgatttcatcatggaatcgaaaagatgtagtactcatatttgttggtggtgggaactgcagtgatataattgaatcaaaaaaaactactttcaacgggacattaaaacattccaattttttaccccacgatgaaatattaactttgttagcaggggcaaacgttctattaaacctaggggtttcaaattcaaatgcaatttctgggaaaatttttgaatatatgtcttttggaaaaccaattctaaccacttatttcaaagatgatgatgcgtcactgatgtatttagataaatatcctttgagttttacaatcaatcaaacacaattatcattagaggaggcttctgtggaaagtttagtatttgttgaaaaacatctgggtgagcaagctgaatttggaaaaattgaaaaaatattttacaatagtacaccagaagcagtagtgagaaggatacgggagcatttgctatgaaaataggaattttatttgatgatgttggaaaagcgggattggactattcagcccctccagaagggaaccctggtgttggaggaacacaatattgttttctaatgctaatgtattatctcagcaatatacaacaagaagatgagattattgtatattgctggaaccataagggaagtgtatttccgaagaataaaaatttacatattaagtatatcaatgaacctgaagaagctatagaattatcagttaaagacaccatcgatatttttctattcaattttagtcatatgttaacatttcaatcgttactagaaaaatcgtctttaagatgcattacttgggtacataactgggttagaggaaagctacttaatgccatggcggaatgttccgcagtcaagagggttgtttttctaggtcaagaacactatgatagatatattgatagtcccataatggacaaagctgtagtacttccgaatatgtttaatacggaaggttatattagaagagataaggatttatcggcagtcgttacatatgtgggtgctttaattccaagtaagggtttccacgcgcttgcggctgtatggaaagacgttatccgtgcttttcctgaggcaaaactatatgtattaggtgcaggaaatctttatggcacggttgatggaggaatagagccagtatttgggaagttaggaattgctgatagagagtacgaagaacagtttttaaaatatattactgataaagatggaaagctattaccttcgattcattttttgggaaatgttggacgagaaaaaattgatatatataaaaaaacaaaagttggtattgtaaatccgacaggaaggacggaggtatgtccaattagtgctttggagatgggggcggcggaagttccagttatttctaaaaatataaacggtttgccagatgtggtcataaacggtcagacgggcttgttggttaacagtaagaagcaacttacacaaagtattattgaacttcttagtgatgatgagaaaaacaagcaactaggtgaacatgctagaaatcatgttttttctaattttaaccctgaaaatattactcaacagtgggttcgagtcttcaaagatatgttggaggatggagaagtcgaagttatctcaccttcaaaaaatatgagaaacaattttaaatgggcgagggtggttttatataatctaaagaaaatacctctgtttcataatttaccagctatgattgaaattgaagattggatatcaaaaagattatatggataagaagagattatcactgaatctgattgcaagtatattttcatatgcgttatcaatttttttcagtttttacttaaccccctatttggttaatcatttaggaaaagagctttacggtttttatggtattgcgaacaatcttgtcagctacataatggtcatatctatggcacttaattcaatggctgccaagtatataacagtggaacttgtaaagggagagaaagttagagctaagcaatattttacatctatatttatatctaatgttgcacttagtctcgtgctggttcctattctcgttattttaacgatacatctacaagactttttatctatatcagttggtcatctcagacaagtacaattcttatttgcttttgtttttttagcaatgcttatccgtttggtttcgtcaatttatggaactgctacctatgcagcaaatagaattgatatacgttcctatatcgaaatgggaaaatctattcttagagtcgcactttatgtagttattttctcactactagatgcttcgatagtacatgttggttttattttattggtattggagctatttaattctattatacaaatctccctatcaaaaaaattgctcccagagatgactattgattttagctactttgatattaaattggttttttctacactaaaggtagggatttggaattcagttaatcaactcggtgatttacttttatctagctccggccttgttttagccaatatatggttaggggaagttgctagtggtaatgtctccattattcagacaatgccagcattgataagtgggattattactgctataaatggcgtgtttatgccacggattgcacataagtatgctgtttcgaaaacatccgatctattggacgaagtgcaaatgtcacagagagttacaggtgcaataataaccccgattatcatattgttgatggtatttagttacgaattttataatttatgggtcccaggaaatgatattgagttacttcaaaaactatctataattgatattgcaaggatgatgattattggggttaactggccagttcttaatttaactatagtaacagataaggtgaaattcccatcaattgttttaatcggcttaggtgtgctgaatattttgattgtgaatttactaatctccttcactaatttaggagttttcgcaattgttttatcaacacttataataacgatacttttctatggtattgcgattccactatactctagttttataataaagcaaccctggtctgctctatacaaacctatttgccaaatgatagttgcaacgacagtcatgttaccggtcactttatatatccattcactgtttagtatacatagctggaaggattttattctttcaggcttcatggcggcagtagtttcttatacaatcagtatatgtgtatttattggtccgaaattcatttttaaattaatcccaaagtgttacaaatagtaaggagaaaaaaatgtcattattttcaggaaaaacactattaattacaggtggaacaggttctttcgggaatgctgtgttaaatcgctttttggcgacagatattgcagaaattcgtgttttttctcgtgatgaaaaaaaacaagatgatatgcgccatgaatttcaggctaagatgcccgaagttgcacataaaattagtttctatttgggagatgttcgtgatttgcagtcggttaaaaatgccatgcacgatgtggactatgtatttcatgcggccgctttgaagcaggtaccgtcttgtgaatttttccctattgaagcagtgaagacgaatgtcattggaacggagaatgtgctgacagcggctattgacgcaggtgttgaaagtgttatctgtttatcaaccgataaagctgcttatccagtgaatgctatgggaacttctaaagccatgatggaaaaagttgttgtggctaagagtcgaacaactacaaaaacgaaaatctgttgtactcgttatggaaatgtcatgtgttcacgtggttccgttattcctctctggattgaacagattaaatcaggtcagccattgacaatcacagatggtagcatgacacgttttatcatgagcctggaagaagctgtggatttggttctctttgcctttgaaaatggtcaaccaggagatattcttgttcagaaggctcctgcttgtacgattcaaacacaagcagaggcagtgtgtgagttgtttggaggagataaagaagcgattcgtgtcattggagttcgtcatggagaaaaaatgtacgaaactttattaacaaatgaagaatgcgccaatgcaattgatttgggtgatttctatcgtgtgccttgcgacaaccgtaatttgaattacgataagtatttcaatcaaggagatgttgatcgtaatccactgacagaatttaatagcaataatacagagttgttgtctgtagaacagaccaaggaaaaaattgcttccttggcctacattcaagaagaaatggcaaagttaggataagtaagaatgacaaaatatacagaagtaaattggaaaaacaatggcaaactgaaacttttgattattgttggaactcgcccagaaatcattcgcttgtcagaggttattaagaaaacccgtcgttattttgatgtggtcctagtccatactggtcaaaactatgattataacttaaatggcatcttcttccacgatttagatttggaggagccagaggtctatctaaatgctgtaggtagtgatttgggtgagaccatggggaatatcattgcagaaagttataaactgatggttgcgattcaaccagatgcagtgcttgttttgggtgataccaactcttgtctttctgttattggtgctaaacgcctgcacattcctattttccacatggaagccggaaatagaagtaaggatgaatgtctaccggaagagaccaatcgccgtatcgtagatattatttctgatgtcaatatggcttactccgagcatgcccgtcgttatctggctgacaatggcttgcctaaagagagaacctatgtaacaggttcgccgatggctgaggttttaagggtgaatttagaaaaaattgagtcatcggatatccaccagcgtttgggtcttgaaaaagggcgttacattctgttgtctgcgcaccgtgaagaaaatattgataccgacaagaacttcatcagtttgttcactgctgtaaataagatggctgagaagtatgatatgccaattctgtattcttgccatccacgcagtaaaaacaagttggaatcatcaggttttgttttggataaacgtgttatccagcatgagccgctaggcttccatgactataattgtttacagatgaatgcttatgctgtcgtttctgattcaggaactctaccagaagaatctagtttcttcacttcagttgacaagcctttcccagcagtttgtattcggaccagtacggagcggccagaggccttagataaggcagatttcattctttctggaattgatgaaattggtctcctgcaggcggttgatgtggctgtagctatgaatgagcacaaacatttaggcttgccagtacctgattatgttgatgaaaatgtatcagataaggttgtaaaaattattcagtcctatactagcatcgtcaataagatggtttggcgtaaatactaaggagacttcctatgaaaattttagtaacaggcgcaaagggaatgcttggaacagcattggtaaatcacttgaagacgattcaaagtgggaaaaacagaacgcgtcctaatctccatatccaatctatttttgagtatgatatagattcgacgattgaagaattagagcagtattgccacgaggcggactttgtttttaatcttgcgggtgtaaatcgtccggagaataccggagaatttatgcagggtaattttggcttcgccagtcagctattggaacagctcaaaaagtacaatagtaaggctcctatcatgctatcttcttctattcaggcaaccttaattgggcgctatggtgatggggaatacggaaaaagcaagctggcaggagaggaattattctttcagcatggtcaggaacagggagtaaaggtagcagtttatcgtttcccgaatttgatggggcattccagacccaattacaattcggctgtatcaacattttgttgggcgattgccaatgatcaaccttattctgtttcagatcctaaggcggaagtcgaactgctctacattgatgatttagtagatggtatgttggatttgttggagggcaaggaagtttattgtaactatgaggggctaactccagttgaggatattagtggcaaatatgcttggattccaaccactcatcgtgtcaccttgggagaaattattgctctcttggaatccttcaagcaacatccattgaccttgatgatgcccaagattccagccaactcctttgcgaagaaattattttcactctatttgacttacttgccgacagaaaagttcaagtatggtctaaaaatgaatgtggatgacagaggttctttcacggagttgttacacacagctgattgtggtcaggttagtatcaatattagcaagccaggtattaccaagggtcaacattggcacagtagcaagtgggagcaatttatagtagttagtggcagaggtctaattcagcagagaaatattatcacaggtgaatttgtggaatttgaagtatctggggacactattgaatccatctacatgattcctggttggactcataatattatcaatctatcagatacagaaaatttagttacagtcatgacctgcaatgagatttttgatccgaatcgaccagataccttttttgaagaagtttgataaagtgacagttttcttgaatatatagtaaaattctcctaattatggaacataactacgattaataatttctatgtggtttttggaatagttcttttccaactctttatcaagaatgatatgttttggtagtccgaaatgttttcagaataagtattgaagagtcagctagaatgtgagggttaattgtattttttgaagttttactataattacaattgttatttttaatggattcattttatatcttagataggcaagggttgtggagatattttaagagtagtactgataaatggttaataatagttgcatatttcgtaacagcccaataacaaggtatctatctactcactccctcctccagtatactgttagagcccgtcccattgactgttccccaatattgccactttgagaagaaaggcagaaatgatattctgatgaaaatgcgtctcggaaaagtggaagtcacattctttcactctatcaaccaagagacgtttcaacagttacaaactctccgtttacagcacaagctaactgctcactcaaaaaagtttgttcttcttcaactgtcatataagcgtggcgacgacctcctctagcatctgaagtaagacatgttaaaccatgttcttgatatttcttagtcaatctccaaaccgtatcatgtgagacatcaagcatatccataatggatttgtagggagtttgaattgccctgagataaactgcttgaatacgtttgtgataaggtgctaagtttttatcttttagagctgttttgagctctgttatcatttcgttagtaaattccatgttttagtttttgaaattagttaagcattaaatgtaaaaacaatatgaaaaaatacgattatctagttgttggtgcaggtctgttcggtgcggtctttgctcatgaggcagctaaaaagggtaaaaaaataaaggttatcgaaaaacgtgaccacattgcaggtaacatctacactaaagaagtagaaggtattcaagtccatgaatatggcgcgcatattttccatacttctgaaaaagaaatttgggattatgtgaatcagtttgcggagttcaaccgatatactaacacaccagttgccaactacaagggtgaaatctacaaccttccattcaacatgaatactttcaataaactgtggggcgtggtgacccctgctgaagcagcagcgaagattgcagagcaacgagctgtattgggaggaaaaacacctgagaacttggaagagcaagccatctcactagttggtacagacatctatgaaaaattgatcaagtcctacaccgagaaacaatgggaaaagccgtgtacggagttaccagccttcatcatccgtcgcttgcccgtgcgtttgacttatgataataactactttaacgatacttatcaaggtattccaatcggtggctacacgcagattgttgaaaaaatgttggttcatgagaatatcgatgtggagacaaatgttgatttctttgccaataaggaagactatttagctacctatccgaagattgtatttacaggaatgattgacgaattctttgattaccaacttggtgaattggagtaccgtagccttcgatttgagacagaagtgttggatatggaaaactatcaagggaatgcggttgtcaactatacagatagcgagacaccatatactcgaatcatcgaacacaaacatttcgaatttggtacacaaccgaaaaccattattactcgtgagtattcgaagacctggaaacgaggcgatgagccatactatccagtaaataatgaccgcaacaacaaactctatacggcctacaagcgccttacagagcagcaagaaaatgttatttttggtggacgtctgggtcattatcgttactacgatatgcaccaggttatcggtgcggccttgcaatgtgtgagaaatgaagttggggaatgattttgagaagtcatcaaggtagtaattgattcttggcagaagttgatactcttcgaaaatcaaaattatccgttgtcaacttgccttgatgaactccagatctatcttcgacttcgtttcctaggctacttttgattttcgttgagtatgaaatgctctcaaaatattatactgttcaaaaaacaaaaactaacgtataatagatttatgaaacttactatcgaacaaacaaacgaattaaaaacttatttgaaagataaaacctattccccatttcatagacgacttcaagtaatcctgttcagagccgaaggtctcagttatagagaaatcactaaccttatcggctattcaaagtatacaatctggtccttacaaggcaagtatgagcttggtgggatttcagctctagtaagagaaacgcgaggtggacggaaccgtcaatatttaacccttcaagaagaggaagcatttctaaaagaacagttaacagcttcactaaatggcgaatttgtgaccataaactctctctacgaaacttatcagaaacgggttggacaccctacgaccaaggaaggattctatgcccttctgaaacgccatggttggcgcaaagtgacgccaagaccagaacaccctaaaaaagcagacgccgaaacgattctagcgtctaaaaataaaatcttcattcacgaaaataggaaagcgcttcaagaatagtcgtcgctatcataaagtcagactaatgtatcaagatgaggcgggtttcggtcggattagtaaaattggaaaggcctgggcaccaaaaggggtgagaccgcatgtacatagccactatattcgtgagtatcgctattgctatggtgctattgatgcccatacaggagagtccttcttcattatcgctgggggttgcaatacagattggatgaatgtttttctcaaacaactatctgaagcttatcctgacgattatattttattagtgatggacaatgccgtttggcataaatcaagtaccttagagaaaccacataatattggttttgagtttattcctccctatactcctgaaatgaatccaattgaacaagtttgggctgagattcgaaagagagggtttaagaataaagcttttaaaacactagatgatgtgataaacaagcttcaagaagtgatacgagagttagattggtctattttaaaaccaattgttagtagacgatggttaaaaaacacttgattggtttgattttgatttttgttgagtattaatcaaaaaaaaaccagaatttctggtttttttgattattgaattgctgccaacaggtcagctgcttgttgctcgagttttgttagagtttcatcagacaactctaatacacctgttgcccatgcttctggattgatggttgaacctgtaaattcaccagcaatctgagtacggataaatggaagaaggtgttggaagtctttgaataggtggtcgtgaccactgtttgcgactgcagagacagttgtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaggaacgcttcagctttttttgccatttgatggttaaaagaaccgtcacgtagtgaaccaactaaaaacaatacgtttgccatgatggcctccttttcataaaaacataaatttagtatatcgtatttgtcttttgttggcaatcctaggtctgctggttcttgaattttttaagtatctcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgatagtcttgtagatataaccatctcgaatcatgttttttataacgacagtcatgttgccagaagtacttaataatttatcaattaagtcttgaatccgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtactttatatagcatagaggagctgaactgtgggtcccagttcttatatccgttctctgtctgaaggagaatgaaagtttattcacaattcaattacggaaaaaatggaaatatgctttaacttgtagtataataggactactatggaaaaaaagatttttcaacttttggaagtattggcaacgaagaagggacagctgatagctggttcctttatactcctaagtgtcatgactttttcgatattcgttatttgggaccttgcagctaagcctttttctgatgtacagaatcacgctatttctgtagctcgagactatgcggatatagaggttgttgatgatgtctctgtctacaacgggacagaaacatactttaccctacaaggaaagactagtcagggggaaatgattgcggttatcattcctgaagagacaaatactgtgtacgtttatccaatggcgaatggtatttctaaggaagaagcgcaggcagtcgctacagagaatggtgcgtcagcagctgatagggtgattctaggttttagggatgacaaaccaatttgggaagtcaaatcaggtactgcctactatttagttgaatttgaaacagggaactttatcaacgggagggcttatgagcaagttatcaagacgagtcttagagatggaagaaagtgtaactctggcagcaggtgcgcgtgcaaaagccctgaaggcagaaggacgtga

SEQ ID NO: 63 - DNA, 32901 bp, Streptococcus suis
tttaatcccgttttgttttttccttgatccattgactgacgttggacagggccttgctttgctctgccttgcgtttttgttcctggacaaaatctgcaaagctttgcttgacgccgtccttttgaaccttgtcctgcaaatcgtgccatttctttttaatgttgctagaagtccgttcgtagtagtcttcaaggatttcttccttggacttgtaattgcggtagaaggcattgcgtgacacaccagcttttcggaccaattcagataccgaaatttgcctgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatggggtagtttaatgatataattgtaagtaaatagagatttattgtcaaataaaaaagtaaaattggaaatgagaatattatgtcaaaatggaaaattgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtcggcgtgtccaagtccgcaggcttatcaggcagcttttgtgggagctgagaacattatcgttgtgacgattacaggtgggctatctggtagttttaatgcggcacgtgtagctagggatatgtatatcgaagagcatccgaatgtgaatatccatttgatatagtttgtcagccagtggggaaatggatttacttgttgacgaaatcaatcgcttaattggtgcaggattagattttccacaagtagtagaagcgataactcactatcgggaacacagtaagctcctctttgttttagctaaggttgataatcttgttaagaatggaagactgagcaaattggtaggcactgtcgttggtcttctcaatatccgtatggttggtgaggcaagcgctgaaggaaaattagagttgcttcaaaaggcgcgtggtcataagaaatctgtgacagcagcctttgaagaaatgaaaaaagcaggttatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgttttctaagttcgaggggggattgtttgtatgagactattagatttcattcattcaaatatcttacgaattgctccagtttatctgcaaaatcttgttcaaagaagatctgtaagaaatcagctttctgtccactgaaataataacatttgccaaacatgtgttggatgctaggcgaaagaatccccttgcttagctgaaaggtcacgctccctttggaaattcgaaacgggatgttcaaagcgtatttctctaaacaatcttttattttattccactgagcgtgataaatatgatgaagatgctgtgtgttccgtgcaaacataccgttatcaatgtagagcgatagagctttttgcatgataagattggtatcgtagtcgattagactcttatgtttgatgaaggtatcacgtagctgattaggaaggctgattgcaccgattcggagggcaggaaagagtgtcggtgtaaaagattttatgtagatgacacgattatctgtatcaagatagtgtaaaggtaggctatgactagaatcgaaatctgctaaatagtcatcctcaatgatgtagacatcgtattgctttgctaattttacgatggctgtttttgttgctatatcataagttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgaataggtagggttctctatcaagatttccgtttttccagccaaggtttccatttgtgtgagaatatatagagcttgttggctaccagctgtgataaccagctggtctttttttgtatagacatgataatccattaacagactttgaacggaggaaatcaattccgctaatccctcttgctggtgatagtagttgaataggtaattttcccgcccaataagactttcgtttagacaaattcgaaaatcttcatagggtaattcttgaaagtctgcaggattgagctctacagtatggtcttggaaatctctatcttctaagatataataaccgcttttttcgacagcgtagatcttgttttggtattttaattccaacatagccttttggacagtgtctttgctacaatgatattgctcgctgagttgacggatagaaggtaatttctctccacgtttgaatcggtgttcctctattccagtcaaaatatcttggatgataacttgatattttttcatctaggcccccttttttatagactatgttactagctagtatataagaaaaattgaagaaagacaatatatgaatgatggggttgaggttcaggaattaagctactctatggtataattaagtgatgaaaataattatacctaatgcaaaagaagtaaatacaactctagagaatgcctcgttttatcccctgtctgatcgaagcaagcaggtgctggatgccataagtcaatttgatgtaaaaaagatggctgccttttataaattgaatgaagcaaaggctgagttagaagctgatcgttggtatcgaatcaggacaggtcaagcaaaaacctatccagcctggcagttatatgatggtctcatgtatcgttatatggataggcgagatatagattcgaaagaagaaaattacctacgtgaccatgttcgtgtagcgacagccttatacggattgattcatccttttgaattcatttcacctcatcgcttagattttcaagggagcttaaagataggcaatcagtctttgaaacagtactggcgaccgtattatgaccaagaagttggtgatgatgaactgattctctcactggcttcgtcagaatttgagcaggtgttttctccacagattcagaaaagattagttaaaattcctttcatggaagaaaaagcaggtcagctaaaagttcactcaactatatcaaaaaaaggtagaggaagattgctgtcctggttggctaagaacaatattcaggaattatcggacattcaagattttaaggtggatggctttgaatattgtactgaaaaatcaacagagaatcagctgactttcatacgctcagttaaaatatgaaaaaaagaacaagatatgaacaagatgacgtttttcatcactaaatacggctatgcggctagtaaaatattgttttttgtgatataataggtgagttataagtaaaaggaaggttgtttatgaagaagagaagcagatggaggaaatcgcctaagcttaagttggtaaattttgcgctttgggtgctatatgccattattctatgtctgttcttagtgactatgtatcgctataacatcctagattttcggtatttaaactatattgtaacaatcctgttgataggggttgcggtattgactggcttgttgatgtggcgtaagaaagcgcgtgtctttacagcactcttacttattttttcactggtcatcacttctgtcggaatctatggaatgcaagaagttgtaaaattttcaacacgactaaattcaaattcgacattttcagaatatgaaatgagcatcctcgtcccagcaaatagtgagattacagatgttcgacaggtcactaatgtacttgctccggcggaatacgatcaagacaacatcactgctttattaaataatattttcaaaatggagtctactcaattaactacaagtccgacgacctcttatctaacagcctaccaagctatgctaaatggtgagagtcaagcaatgattttcaatggagtttttaccaatattttagaaaatgaggatccagacttctcttcaaaagtgaggaaaatatatagttttaaggtgactcagactgttgatacagctactaagcaggtgagtggagacagttttaatatctatattagcggcattgatacatatggcccaatttcgtctgtttcgcgttcagatgttaatattattatgactattaatcgtgctacacataagattttattgacaactactccacgagattcttatgttgctatcgcagatggtggacaaaatcaatacgacaaattaactcatgctggtatttatggtgtcaatgcctctgtgcataccttggaaaatctttatggtatcaatatcagtaattatatccgtctcaactttacatccttcctacagttgattgatttggttggaggtatcgatgtagaaaacacccaagagttcacaagtggtgaacacacttttccagtgggaacagtacacttaaatgcagagcaagcgctaatctttgttcgtgagcggtattcgttggctaatggtgataatgaccgtggtaaaaaccaagaaaaagtcattgcagcacttataaaaaaattgagctcaccagagaatttacgtaattatcaagctattttaaatagtttagaaggatctattcaaacggatctaagtattgaaacaattataggcttagttaatacgcaattagaagccggcacacagtttacagtggagtcacaagcgctagttggaaatggtcggacagatctgccttcttatgctatgccagattcacaactttatatgttggaaataaaccaagaaagtttggaacaaacaaaggctgctattcagtcagtattggatgaaaattaaaaaaatagggagaaaacatgaataatcaagaaatgaatacaatcgaaattgatattttactcttactgaaaacgatttggagaaaaaaaatctttatccttctgctgggactattaggtgcagggttagcttttgcttatagtagttttttggtaacaccgcaatatgattcgacgactcgtatctatgtagttgggcaacatgctgaagctggcgcgggattaacaaatcaggatttacaagctgggtcttatttggtaaaagactatcaagaaatcatcctatcacaagatgtactgacacaggtggctacagagttgaatttgaatggaaacctaaaagaaaaggtttcagtttctattcctgttgatactcgtattgtttctatctccgtgcgtgatgcggacccaaatgaagcagctcgcattgcaaatagtctccgtactttcgcatcacaaaaaatcatcgaagttacaaaagtgagtgatgtgacaacacttgaagaggctgtcccagcagaggagccatcaactcctaataccaaacgcaatatcttgcttggtttattagccggcagtatcttggcaacaggtctcgtgttggttatggaaattttggatgaccgtgtaaaacgtcctcaggatatcgaagaggtaatgggattgacattgctaggtgtagtgccagattcgaagaaattgaaataggagaaaaatatggcgacattagaaattgcacgtacgaagaaagaattagtaaataagacggaagaatattttaacgctatccgtacgaatattcaactcagtggggaagatattaaagtggttggcataacttctgtccaatcaaatgaaggaaagagtacaacagcagccagtcttgctattgcctatgctcgttctggctacaagacggtcctggttgatgccgatattcgaaactcagtgatgtcaggtttctttaagccaattacgaaaattactggtttaactgattatttagcaggaactactgatttatctcgagggctatgtgaaacaaatattccgaatttaacagttatcgagtctggtaaaatatcaccaaacccaactgcccttctacaaagtaagaattttgagagcttattagctactcttcgtcggtattttgactatgtgattgttgactgcccccctctagggatggtaatcgatgcggcaattattgcccagaagtgtgatgcaatggtcttagtagcagaggcaggacatgttaaacgttcagctgtgaaaaaagtaaagggacagttggagcaaacaggaacaccgttcttaggcgttatcttgaacaagtatgatattacaactgagaaatatggcgattatggaaattatggtaactatggaaattacggtaaaaaagcttgatttttatgatatgagctttgattaggtaggtgttagtatgattgatgttcattcgcatattatatttggtgtggatgatggtccaaagacaattgaagagagtctagatttgataggagaagcttatcgtcagggggttcgcttcatagttgctacttctcatagacgaaaagggatgtttgaaactcctgagaaaattattatgactaattttgttcaagtaaaagagagagtcaaagtagcttatccagaaatgactttatgttatggagcggaactttactatagtaaggatattccaagtaaactcgaaaaaaaggaagttccaactcttaatggaacgcgctatattctcctagaatttagtaagaatactccttggaaagaaatccaagaggctgtgaatgaagtaatgttacttggactgactccactacttgcccatatagagcgctatgatgctctggcatttcagtcagagcgagtagaagagttaatcgacaaggggtgttatactcaaattaatagcaaccatgtgttaaaaccaggtttaattggtgaccgagcaaaagagtttaagaaacgggcacggtactttttagagcaggatttggtgcactgtgtggctagtgatatgcataatttatcaaatagacctccgtttatgagagaggcttataagttaataatagaggaatttggggaagatagagcaaaagctttattgaaaaagaaccctcttatgttattaaaaaaccaggtgatttaagctggttactctagattttggagaaaaaaatggatttaggaactgttaccgataaactgttagagcgcaatagcaaaagattgatacttatatgcatggatacttttcttattgtagtttccatgaatttgagtagactgttcttggatattattattgacattccagataaacgtttcattcttgcagttttatttgtattgatattctatctgattatttcagttagattaaaggttttttcgttaattacgaggtataccggttatcagagttatgtaaaaataggattgagcttgatatctgcttattcattatttttgattatctcaacgattttatggcagagttttagttatcgcttcatcttagtatccttatttttgtcatatgtattgctcattaccccaagaattgtttggaaagtcttgcatgagacacgaaaaaatgctattcgtaagaaggatagctcactgcgaattttggtggtaggtgctggagatggtggaaatatttttatcaataccgtcgaagatcgaaaattgaattttgaaattgtcggcatagtcgatcgtgatccaaataaacttggaacatttatccgtaacaccaaagttttaggaaatcgcaatgatattccacgcttagtagaagaattggcagttgatcaagtaacgattgctatcccttccttaaatggtaaggagcgagagaagattgttgaaatctgtaatactacaggagtgactgtcaataatatgcctagtattgaagatattatggcggggaacatgtctgtcagtgcctttcaggaaattgacgtagcagaccttcttggtcgaccagaggttgttttagatcaggatgaattgaatcagtttttcaaagggaaaacaatccttgtcacaggagcaggtggctctatcggttcagagctatgtcgtcaaattgctaagtttacgcctaaacgcttgttgttgcttggacatggagaaaattcaatctatctcattcatcgagagttactggaaaagtaccaaggtaagattgagttggtcccgctcattgcagatattcaagatagagaattgatttttagcataatggctgaatatcaacccgatgttgtttatcatgctgcagcgcataagcatgttcctttgatggaatataatccacatgaagcagtgaagaataatatttttggaacgaagaatgtggctgaggcggctaaaactgcaaaggttgccaaatttgttatggtttcaacagataaagctgttaatccgccaaatgttatgggggcgactaagcgggtagcagaaatgattgttactggcttaaatgaaacaggacaaacacaatttgctgcagtaaggttcggaaatgttttaggtagtcgtggaagtgttgttcctctatttaaggaacaaatcaaaaaaggtggtccagttaccgttactgactttaggatgactcgttacttcatgactattccagaagccagtcgtttggttatccaagcaggacatttggcaaaaggcggagaaatctttgtcttggatatgggtgagcctgtacaaattctggaattggcaagaaaagttattctgctgagtggtcatactgaggaagaaattggaattgttgaatcaggtattcgtcctggagaaaaactctacgaggaattactatcaacagaagaacgtaccagcgagcagatttatgaaaaaatatttgtaggtcgcgttacaaataaacaatcggacattgtcaattcatttatcaatggattactccaaaaagatagaaatgaattaaaagataagttgattgaatttgctaaacaagagtaagaaagtaaaaaaaatatttttactttcctagagtttaaacgatgtttaggctctaggatggttgaaatacttaatgaatataatattggagagtcggttccaagatatttaaaatttagtaaatttgctttacattattaggagactatcggcttttatagatatgaatgagttgataagaataaaattaaaaatggagatgaaaatgtatccaatttgtaagcgcattttagcaatcattatttcaggaagtgctattgttattctaagtccaatcttattattgattgcattggcaattaaattagattctagaggtccggtactatttaaacaaaaacgagttggtaagaataaaaaacacttcatgatttataaattccgttctatgtatgtagatgctccaagcgatatgccaacccatcttttgaaggatcctacagtgatgattacaaaagtaggagcttttctacgaaagactagtcttgatgaattacctcagttattcaatattttcaaaggagaaatggccattgttggtccacgtccagccctatggaatcaatacgatttgattgaggagcgagataaatatagagcaaatgacattcgtccaggtctgactggttgggctcaaatcaatggtcgtgacgaattggaaatagaagataaggcgcgcttggatggttactatgttcaaaataggagttttggcctggatgtgaaatgcttctttggaacgtttctcagcgtagccaagagcgaaggtgttgtcgaaggcggaacaggacaaagggagaaataaggtgaaaaagaagaaaaagcatattttagttgtatgtcaatatttttatcctgaacaatttcgaattaatgatatttgtctaagattggtagagcgaggacataaagttacagtattgactggaatccctaattatccctcaggttcctattatgacggataccattttttttcagggaacgaagagtataatggtgttaaaataatcagacttcctttgctcccaagaggaaaaaataaatttagtatggttttaaattatctcagttttgttgtatcagggtatttttggaccaagttaacccgtttaaaatcagatgccgtattcatttaccagttatctccagtaactcaagcactcccaggtatttggtatggaaacaaaaataaaatacctaaaatactctacgttatggacttatggcccgaaagtatggaagttgtcggaggaattcgtaatagacaggtaattcaatatataaataaaattgttgactatatatatcacaattcagaaaatatcttaacctcctcacgaagtttcatgcagaaaattcaacagaggggaattaaacaggataaattggtattctggcctcaatatgcagaggattattactcacctgtaagtacacgcaaagataatgaaatagtagttggtaatggattaaatattacatttgctggaaatataggggaagcgcaaggattagggattctgcccaaagctgcaatcgaattaaaaaatctaggtgtaccagtcatattcaatattattggtgaaggtcgttataagagcacattgatacaggaaattgagcgtttagaagtagaagaatattttaattttatcggtcaaagaaaaccagaagaaattccttattattttgctaatagtgatgcttcgctgattattcttgcccaaaatgagctatttgatatgactataccggctaagttgcaatcgactatggcatgtggcattccaattattgcttcattgaatggagaagccgctcagatcattaaagaatcccaagctggcttagtcagtgaagctggagatgttagagggctcattgataatattttagagttttcaaaacttaattcggaaaataaggaaagtttcacattgaatgcattaaactatagtgagattcacttcaatagagaatgtttattggatgagttggagatacttatagcacgagaattggattcgtgatttaattttgaaaactacaagataagaagtcttaatctagtagaacaagataggaagtgtatatgacaataattgtttacgcagtggcttcacgcagtggaggtgcattgagcgttttaaatgatttttatgaggaagttagagtaagtcaggacaagtatccagacataaaatgggttttcgttttaagtgatcaaaaattagcgagcataggaaatattacgattgtaaatattccgtgggtaacaaaatcatttttccatagattgattgctaatttgacaactgtaaaaaaattatatcaagacaatcaagctagtgtgattgtgtctttacaaaatatgaaagtctttggcttggacaagccgacaatagtatctttacataatgtcctcccgttatataagtgtggatttcaaactttaggaacactaaaagctgtcattaaacagttttttgtaaatcatgctattattcgttctttaaaaactgctaggtcagtattagttccgtcgttttggatacaggaagaattagtgaggcagttcgggattgaaaaatctaatataaaggtctgtaaaacccccatcagtccgagtatagtagattctgtgaaaaattccttggaagaaccgataacatttttttatccagctgcctcctatccttataagaaccacaaagttatcatagaagccatagtattaatggaacgaaagggtaattatccattcaaggttgtctttacttttgatcgcaatcagagtaagaacgctactaatttatggttgcaggcgcaaccttacttagataagatagagttttgtggagaactccctagaaatgaagtacttactttatacagtagtgggatattgctctttccatcaaagatagagacagatgcaatgcccctattagaagggatgcaggcgcatggaaaaattattgcagctgactatccatatgccaaagaagttttagacggttatgacaatattctcttctttgagggagacagtccctcgtcacttgcagagaagatgacagagattattagtacaggggcctttccgacaaacctatcaagtaagtcagctaatatgactaaaacattcaatagcagggttgatacgattattgaaagtttatctgatatttaattatttgtactatatcagaaaaaatgtatagtattcaagaaagtcaaaatatgattatatttatccagatttttttatcattggcggcaataggtttatgcagcagtcgcttactaacaaacgtttttaatagaaataaatatgttaattatgaaaacttttttttgatattgctcatagttgatgtttttttaccagcctttattggagctattactggtatttatcaaaaatttccatatttctctattcaaaatgaaagttcatacttacttgcaacaattatttttatcattggtgctatgctgtttgtattaggattcaagtcagctgattatatttctattaagcagttaaaaccaaatcctaatcaagagtatgttatttcagaaacttttctattgttgtcgtttctttttgtagttgctgtaatggtcacaaacctgctcatcgaatttatttctttaggaagttgggatttgttttatcagtacaagattgctagaatttatctagtgactattgaacatacaactttttttgcaaaaagtattgcactagcttcagaacttactcttattattttgttcataactatgtcagttgggcttgtaaatagtgagagattaaagcatccatttttctggggaaaagtcgttcctgttcttgctttaatattgagtttaacaactatgtatcgtggcacaattttgcaatatggaattgtactcatactatcgttacaatacaagtatggttggaaactgactaaaaaattacggggaagaatcgttcgaataggaatcctgttcatcttagcatttgtagtgtacggggccgttagaaccagtttgaattattcttattggggagaagagaaactaagttttgttgattcatttgttacaatgttaaccaatacgatggggacttctttaattgcttgcgcccgttgtgtggagtacctaaattcaggtaatagtctgttttggggagaaagtatatttcaaatgttctattcttttattcctcagtcaatatgggcagacaaacctactcagtatggaattattacgttgacaactgcaatgggtagcccgaatacaactatggatgcaataacaattccgggtgaattactattgaattttgactatttaggtctactgttgttaattccaattggagtagtatttggattactagaacaaatgcgcttatctaatcgttttagatatctatatattgctagtttgtctgcactcgtaaccacatctatgtggatgagttttactggtttttttgcacaaaccaaatatttcttcatctacgcgattgtgttagtgtttattttccgaaagaaaagatacccaagttgagaaaggcataatgttaaataaattaaagaataatcgtagaaatttacaagaggttttaataacaagcttaggacagttcttatatctttttcaagggctaattcaaaataagatttttgctagttattttgagacatctgtttttggacaatgggcattgctatcatcagcctatgtatttatttcaatgttaccatttacagcattagaacaggggatatataaggaagctattcctgcgaggaaaaatggtcaagataggcaactgtattcgctgattgcaggagtttattcaatatgttttagcatatacactgtagttttggtttttctaaatatactccaaggagaaagtttctttgcggatggatacctatttctattccttttttatgcatttacagaaatttttaagaacacttatcttgtattggataatgcatatcgctatagaaaacgcgtgttacttatcagattgttggacttgttaagtagaataattccgtacctgttactatttcaaattggtctattttccatcaaggcagtcttaattgttctatgtttaagtaatcttctagtattagtttttcaaagaaactacataaaagaaattcgtcttccgatagataaaattgctactaaagagatatttcaaaatattgttcaattttcagctccattgatggtttgggcaatctttggctggttgcaaaatatgattggtaggtggtacctagatatgttcttagatttagaagctgttgccgcctacacaatattaacatcactatcttattttgtgcctaatatggtttatacagtttgtaatgcctatatcatgccacttgtattttcacggactgagaaacttaccaggaaggaattggggaaatatcttgcgattctatcaggatttttcgctgtttattttatcgctattgtactcttgggacgatggttgattattttgttggcagatcccaaatatctgtcaatattagattatttgccaatcactactttaagtgcaatactgtatgtgttggccatgtcatcgactattgaaatctatcgtcgaggggagaccagaaaactcttagtatcatccattgtaccaggagcggcaatggcaacgattggttttgtgttaataaaggagtttcagttccaaggtgttgttataaactatgttatgggacatattatttatactgtgttgactatgatggttgtactaagaaatattgactagaatcacgcgaggggaaaatgaaggatactgttattttaataaatagttgcgatgcttattcagatgtctgggaaccatttttcaaaatacttgaaaaaacgtggccagaaatttcaaattatagaattgttctaaatacagaaacaaaacaatacagaaatcagtattttgacattgaggttatgaatattttgccagggaaaacgcccaatattccgtggggagagcgtctcttagatgtactaggacgtttagaagagaaatacgtgatttttctattagaagatttcttttttgaagaaaaagtgaatcataccctcatagagaaatatttaacctatctcaaaaataatcaggatattgcgacattatcgctaacttctcctatggattctaaagaacttgaatcttatcaaaaaacttctctctatgaagaatttgctgaacgtggtcaaaaggcatattataaattaaatgctggaccaggtatttggagaaaatcagctcttgttgaatttaccagagccacagataatccttgggaatgggaattttttggcagtatgcggacttggttttctaactcaaaattctatgggctcaagcaagaaactgaaccagtttttaaatatgatatagagcatggtggcgctgttcacagaggaaagtgggtcggatataagttggatgaaataatcgaaaaatatagtctgacgattaacttttctcagcgtccaatagaatatgattggatggtagatgagcctaagtccacacctatttggctacgtctcccaagtattttgaaaaaccgttcaaaggcttttataacgatttgtggcagttttcttaaatatcgtttaatgaggagtaggtaatggtagatatttgtgttattatgagtgtttacaatgaaccgttggagtatgttgaacaatcaattaattcaattttaagtcaaacgaaaaaggcttttcaatttcttattatttgtgataatcccatgcgttcagagttattagagtttttatctgactatgaaatggtagattctcgtataactatttctgtaaacgatacaaatataggtctagcagccagcttaaatagggcaataaatcttgttgaagcccgttactatgtaaggatggatgcagatgatgtttcttttcaacataggttagaggtccaatttgcttatatggaggcgaataaggactgtgctattatttcaagttgtcactcattactaaacgatagtcaacttttgtatcaagaagaaataccatatcaactttctccagagggcttacgtaaaattttactatggggatgtccaattttgcattcttccatcatggttcgtggagaggtttatagagaattaggtggctatagaagtttacctgttgctgaggactatgatttttatttaagagcacttactgccggatataacattgaaaaaataagtgatgtattattgacttacagaataaatcccaatagtatgactcactcaaacatctataaaacaatatgcttgacccattatatacgaagaatgtatagagaacgcctcagaaagggacaagattctcattctgaggaaaaattattagcatttgcgaatcggcatcagcttgataatcctgtttatattcagaaaaggaatcaaatatgggaaaattttaaagcttttcaatcacagaaaaaatatatttccctgctatttctattaatgggaactccgtggttatctaggtatgtgctagaaggaatattttataaatatacattaaacaaatttaggaaggtaaaaccccatgtttaaaggaaaaacactattaattacaggtggaacaggttctttcgggaatgctgtgttaaatcgctttttggcgacagatattgcagaaattcgtgttttttctcgcgatgagaaaaaacaggatgatatgcgccatgaatttcaggctaaaatgcccgaagttgcacataaaattagtttctacttgggagatgtccgtgatttgcaatcggttaaaaatgccatgcacgatgtggactacgtatttcatgcggctgctttgaagcaggtgccatcttgtgaatttttccctattgaagcagtgaagacaaatgtgattggaacggagaatgtgctgacagcggctattgatgcaggtgttgaaagtgttatctgcttgtcaacggacaaagctgcatatccagtgaatgctatgggaacttctaaagccatgatggaaaaagttgttgtggctaagagtcgaacaactacaaaaacgaaaatctgttgtactcgttatggaaatgttatgtgttcacgtggttccgttattcctctctggattgaacagattaaatcaggtcagccattgacaatcacagatggcagtatgacacgctttatcatgagccttgaagaagctgtagatttggtcctttttgcttttgaaaatggggaaccaggagatattcttgttcagaaggctcctgcttgtacgattcaaacacaagcagaagcagtgtgtgagttgtttggaggagataaagaagtgattcgtgtcattggggttcgtcatggggaaaaaatgtatgaaaccttattgacaaatgaagaatgcgccaatgcgattgatttaggtgatttctatcgtgttccttgcgacaatcgcaatttgaattacgataaatatttcaatcaaggagatgttgatcgtaatccgctgacagaatttaatagcaataatacagagttgttatcagtagaacaaaccaaggaaaaaattgcttccctggcctacattcaagaagaaatggcaaagttaggaaaataggaatgacaaaatatacagaagtaaattggaaaaacaatggcaaactaaaactcttgattattgttggaactcggccagaaatcattcgcctatctgaggttattaagaaaactcgtcgttattttgatgtagttctagcccatactggtcaaaactatgattacaatttaaatggtattttctttcacgatctgaatttggaagagccagaggtctatctgaatgcggtaggtagtgatttgggtgagaccatgggaaatattattgcagaaagctataagctaatggttgcgattcaaccagatgcggtacttgttcttggtgataccaactcttgtctttctgttattggtgctaaacgcctgcatattcctatcttccacatggaagctggaaatagaagtaaggatgagtgtttacctgaagagaccaatcgccgtatcgtagatattatttctgatgtcaatatggcttactctgagcacgcccgccgttatctggctgacaatggcttacctaaggagagaacctatgtaacaggttcgccgatggctgaggttttgagggtgaatttagaaaaaattgagtcatcggatatccaccagcgtttgggtcttgaaaaagggcgttacattctgttgtctgcgcaccgtgaagaaaatattgataccgacaagaacttcatcagtttgttcactgctgtaaataagatggctgagaaatacgatatgccaattctgtattcttgccatccacgcagtaaaaacaagctggaatcatcaggttttgttttggataaacgtgttatccagcatgagccgttaggattccatgactataattgtttacagatgaatgcttatgctgtcgtttctgattcaggaactctaccagaagaatcgagtttcttaacttcagttgacaagcctttcccggcagtttgtattcggaccagtacagagcgcccagaagccttagataaggcagatttcatcctttctggaattgatgaaattggtcttctgcaggcagttgatgtggctgtagctatgaatgagcacaaacatttagggttgccagtacctgattatgtggatgaaaatgtttcagataaggttgtaaaaatcattcagtcctacactagcatcgtcaataagatggtttggcgcaaatactaaggagacttcctatgaaaattttagtaacgggcgcaaagggaatggttggaacagcattggtaaatcacttgaagacgattcaaagtggaaaaaacagaacgcgacccaatatccatatccagtccatttttgaatatgatatagactcgacgattgaggaattagagcaatattgccaagaggcggactttgtttttaatcttgcgggtgtgaatcgtccagagaatatcgaagaatttatgcagggcaattttggctttaccagccagctattggaacagctcaaaaagtacaatagtaaggcccctatcatgttatcttcttctatccaggcaaccttaattgggcgctatgctgagggagaatatgggaaaagcaagctggcaggagaggaattattctttcaacatggccaggaacagggagtaaaagtagcagtttaccgtttcccaaatttgatggggcattccagacccaattataattcggctgtatcaacattttgttgggcgattgctaatgatcaaccttattctgtttcagatcccaaggcggaagtcgaactgctctacattgatgatttagtagatggtatgttggatttgttggagggcaaggaagtttattgtaactatgaggggctaactccagttgaggatactaatggcaaatatgcttggattccaaccactcatcgtgttaccttgggagaaattattgctctcttgcaatccttcaagcaacaaccattgactttaatgatgcctaagataccagccgattcctttgcgaaaaaactattttcactctatctgacttacttgccgacagaaaagttcaaatatggtctaaaaatgaatgtggatgatagaggttctttcacggagttgttacacacagctgattgtggtcaggttagtatcaatattagcaagccaggtattaccaaggggcaacattggcacagtagcaagtgggagcaatttatagtagttagtggcagaggtctgattcagcagagaaatattgtcacaggtgaatttgtggaatttgaagtatctggagacactattgaatccatttacatgattcctggttggactcataatattattaatctatcagatacagaaaatttagttacagttatgacctgcaatgagatttttgatccaaatcgaccagataccttttttgaagaagtttaataaagtgacagttttcttgaatatatagtaaaattctcctaattatggaacataactacgattaataatttctatgtggtgtttggaatagttcttttccaactctttatcaagaatgatatgttttggtagtccggaatgttttcagaataagtattgaagagtcagctagaatatgagggttaattgtattttttgaagttttactataatcacaattgttatttttaatggattcattttatatcttagataggcaagggttgtggagatgttttaagagtagtactgataaatggttaataatggttgcatatttcgtaaccgctcaacggagtatattgaaaaacgttccaaagcataaaactctggaacgtttttttatgttgcaacgtaaccgactaataacaaggtgtctatccaattactccctcctccagtatactgttataaaaaacaaaactggaggattttttatgtcacactccatcgtcccattgactgttccccaatctcgccgctttgaaaagaaaagcagaaacgatattctgatgaaaattcgtctcggaaaagtggaagtcacattctttcactctatcaaccaagaaatattagaaacaatcttggataaggtactgttctatgacaatccggctcagtgatttaggtcaagtctacttggtttgcggttacttatgtacgaagtagtggtgtgatttggttaagaggattatgctcacttagaatttctacctgcttgctttgagagacatgagtatagatttgtgttacattgatgttactgtggcccagtaaatgttgtatttgtcgaatatcgacgccattatcaagcaacatagttgcaaaactatgtcgaaacatatgtggagtgatatgttttttcagttgtagcgagtgagaaatatttttcagaattaagcgcacactttgttctttaagatgatcatcgtttttcacaccggtaaatagataactagaatgactacaatgatgcgctatatagtcttcaagtaacgaaagtgtttcatcgtttccaatatagagtagtcgctctttctttccttttccgagtatttgaatggttctattttccaaattgatattatcaagttttaaattacataattcagagatgcgtagaccagttgataaaagtagcgagataaggagtagatttcgcatagctttccgcttagaatgcttatttttagaattttctatttgttggtgggcgaaacaatatattttttgtaaatctttcaaggaaatcgttttaggaagctttttctcttccttgtagtggagtcgaagctgatggaagggattttttgaaattagtttttcttcttccagaaatttatagtatgatttaagactagcaatcttccgttttaatgtgctagtcttttttatatgttggttgagaaaagtaagataggacctaatatcattggccccaaagttataatactgatgtaaatcagatttgtatgctcggatagtatgagaactaagtcgtctttgaatagcacaaaagtcaagatatctctggatagtgtcgtaattcataatataatctccttaatatatcgtaataaagttattatatacaataatttatcaatttactaatgataataaattgttatcggtagaggagaactatgaaaaatttgcctgaaattgaattaaataaggatgaaaaactctttttatttgaaattgattctagaataaaagcattgttactagagttgcctgaatcatatcataatagcctacaaattgtaagaggaagtcgttttcgccccctattaacatattatgggtatacgttatattctgatgagttaaatgaaactatttatcaatcagctacagcaatcgaattaattcataaggcttctattataattgacgatattattgatcaggataaaaaaaggcatggtatgccaactgttcatcaacaatattctcttaatgaagctttgataatatcagtatttttactaggaaagtgtatagaaatgctgtcagatattgatgattctactgttagattatttagtcagatgattattaagatgtgccaaggaacattgagtgaattaaatattaacgatgagacagctattgcagatattagaaaaattttggacaatcaaacttctcaagtgatacagaatagtttattgattggcatgaaatcctacaatgaatctatcaataatcaatatttggaaatagttggttataaattagggtatctgtttcaattgttgaatgattgtgaagtattttttaatcctgaattttccatacaatataaaggaaatatgaattttgatattaacaagcagcgaaaaaatttatgttactcatacttagaacagtctcttaactataaagaaaaatccgaacttgattgcggaaggtactctattctggataatttattgaataaatataacatattggattcaataaaaaaagaaatactcgtggtgctagttcatttcaaaatacaataaaaagcccaaatggactatactgtaagtaacgaaacatacaggaggttagtccaaatgagccacttacagtataccgctaaatctcatcatttgcaatggaatgtacgccaattatcacaaatttgtcatcacttctacaacaactattgcccggattccttcaaatatcggcgaaatgttggcttagttaaagtttcagatgaatcaatccttgtcttacttttgttacaagctgaactaggtatgacatcacagcgccatttctacaccatctgccacctcttcccttgcggtcagttactagaaagaagccgtttcaatcgtcggtcaaaacaattgatttggctcgtccaattaatccgaaaagctatgagtgaaatgcttccatctgataaactagccattatagatagttttcctgtgccactttgccaacctgttcgcaatcacagagttaccatttttaaaggattagccgatattggctataacgcctctaaacatctttggttctacggtttcaaggttcatatgctggtgaccttgtcaggttatattctgaactatgttgtcacacctgcctctgtccatgatatcaaggtggtttatgagctattagaagggtgtaagcaatcggttatcctaggtgatttaggctacctgagcagtgaactcaaaaaggacttagagcaagaaggttaccatctatggacgccgtttcgtaaaaacatgacagggtccgaagaacataacaattggaatgtaatggtcatgagacgaactattgaaactcgtttttctgaactgtgtcgtctctttgacatcgaacatacattagctagaagcctagctggactacagttacgaattgaacaaattattctagctcataacttacgctattttgaaatgaactagcaccacgggtaagaaatttattgtattgaattagatatacagaataatttaaatattttaggagaaactatgaatgtgcaacgcttatcattctttattgactatgctataaatttagctaaaacaagggcaagtatcaattaaaaacctagaaaacaacttaatgtttctaggtttttgttcagttattattgtgatagaaaaggtattattacgttatacaggttgattataactggaatataaccaagaggatttacgtattgcccgttgaataattcagggaaattaggtgtgtctctatataaattaaagagatcgataaagtctttatttaattgtgattgttgattcgggatattgtcatattctaaaagtctatttctctttattttttttataattatcttgatataatttttccatagataatcaaacaatatataacccaaaccaattaatatagcgataattccccatgttattatgaatacagtatcattagacgtatttatatttagtttattatttgaaaatgatatagctgataaaggagttgttaaataaaataataaagtataagcaatcccaaggacaccaaagtaattaccaaaagtgctcattgtgtctgtgaatttaacaatccaagtagtctcagatggattatgaagagaaattggagtaaatgtactaaattctagatttgcaatttttcttaaagtaagaatgtaaaatatatactttaagtatagttgtattgcaataaaaactgtaaagattaaagtaatactaccgtatactgtaataactttattccacattaatacttttagcaaaatcaatgaaatgatatagataattccgattgctatagaaataatgatactataccatttttgtagataagttccaaatctgttacatatcgaaaatagcgaatatccatcaatagtaatacctgaaatagacaatgaaagtagatcttctttcctcattaggcaatgatacgttacaatctgtgcaaatagcaaaagatttacaccgagtacgtatacatagttattcttcagcgaagagtcaaaaattgatagaattattccaaaaaaaatccagcatgtaaaaataatgccccatagacatttttttgaaagaattttatcaacaatccatatattcatagcattttcctaccgataacaatttattatcattagtataccataatctacatttgttttatagattttattaaaatttttatagtaaatatttttagttttttgtttcccaaaatgtaatggagattgatttttttgcaagtcattgtcataaaaatcagaaaatatttaataaatatgatagaatggaagtgatactagtttgaggtaaggatatgaaattaagaagaagcgtagaaaaactacagggaacgattcgtgtcccaggagataaatcaattagtcatcgctctattatttttggttcccttgcaaaaggtgttacccgtgtccacgatattttgcgtggagaagatgtcttgtcaaccatgcaggtctttcgtgatttgggtgtaaaaattgaagacaatggtgatattgttgaagtacacggtgttggctttgatggtcttcaagcacccaaaaatgatttggatatgggaaattctggaacctcgatccgtttgatttcaggcgttttagcaggtcaagattttgaggcgactatttttggtgatgattccttatccaaacgtcctatggaccgagtaactattccacttagtcaaatgggagtagagatttctggacaaactgaacgtgacctacctccgttgaccatcaaagggaataagaatttaaaaccaattcgctaccaactccctgtagcctctgcccaagtaaaatcagctctgatttttgccgccttgcaggctgagggagagtcggtcatcgtagaaaaagatttgactcgaaaccatacagaagatatgattgtccagtttggtggacagttggaagtcaatggcaaggaaatccgcatccaaggtggtcaggagtttattgctcaagagattacagttccaggagatatttcaagtgctgccttttggttggttgctggcttaatcgtaccaggttcaaaaattgtccttgaaaatgtgggaataaatgaaactcggactggtattttagatgtcattaaagctatgggcggtaaaatgactctttctaacatggatgaacttgcaaaatcagctaccattacagttgaaacgtcggaattgaaggctacagagattgcaggcgaattgattcctcgtttgattgatgagttgccaattattaccttactagcgacacaagcacatggaacaacgattattcgtgatgctgaggagttgaaagttaaagaaacggatcgtattcaggttgttgcagatgctctaaatagtatgggagcaactattgaaccaacagaagatggtatgattattcacggaccaactgctttacatggtgctgaaatcaatacatttggcgaccaccgtatcggtatgatgactgccattgccgccttgttggccaaagatggagaagttgtattggaaagagcagaagctatcaatactagctatcctgccttctttgaacacttaaatagtttgatggattaggagaacgtatgccaatcgttttacttggatttatgggagttggaaaaacaacaactgcacatttgttaaatctccccgtttacgatatggaccatatcattgaagaacggattggtatgcctattgctgactatttcaatcttgaaggagaggcttcgtttagacaactggagacagaggtgttgaaagaattgctggacttacctagtaattgtatcgtgtcaactggtggtggtgtgattaaatctgaagtaaacagggaattgctgttggcaaatagggaggacaatgtacttcttactgcctcctttgaagtttcctatcagagaattcgtaaggatagacaatcgcaaagacctctctttttacagtgtagtaaggaagagtttgaagccctctatcgtgaacgaatggcactttatcaaggtttagccgatactgtaatcgatacagataaactgaatccagaacaagtagcaaggaaaattttatgcaagtagcctatctaggacctcgtggttcttttacacatcaagtggcccagcaggcctttccgactgcggatttgcaggcttttgaaacgattacagaggttatcaaggcctacgaaacgggggaagttacctattccgttattccagtagagaactcgattgaaggtagtgttcatgaaacgattgactatctctttcatcaggcggagattcatgcggttgcagagattgttcaaccgattgcccaacaactgttagccacgagtgctgataaggctgtagaggttatctattctcatccgcaggcaattgctcaggggaagaaatatattcaggagcattttcctcaggctcgtattgaaataacagctagtacagcctatgctgctcgctttgtggcagaacaccctgaacaaccatttgcggcaattgctccgcaagcggcagctgttgaatatggactggaggtaattgcgcaagacatccaggaaattagcgagaattttacacgcttttggattttgggggataaggctccgtctattgcactggaacaagtagctaaaaaagtcagtcttgcactgacattgccagataacctgccaggagccttgtataaggccatgtctgttttctcatggagaggaatcagcttaacaaaaatagaaagccgacccctgaaaacggctttgggtgagtattttttcatactggatcttgacaatcagtctgaggaattattagcctattctcaaaaagaattgactagtttagacataacctataaagtactagggaattacctggtctatatgaccagctaggatgaagacagatgaataaaaacaataatatcctaacccatcatgaacaattgaggttagattatttgcaaaaaaatatccactacttaaatgacaaagaaagtcgtgagttggattatctattatataaaaaagagctgagagaacggcatggaagtccaaggcaacctctacgtagcttcacaccaacggcttacgaagatgacttcgaggaagattattttgaagaggatgatgagcaagaggaactgttgcctcgctatcctgaacgtagatccagaaaaacaagacaagccaaacctcaacggtttcagtctcctcgtatcgagcccaaagcgaaagtacctaaacctaaaaaagctcgtaaaaagggtggtttcaagcgctttattggtttcgtattgcttgctatagcactagtgattgtagcgatgggctatagttttttcaaaggtatgaatagcgtgagtgagaagccagtagctgaggtcttcaacggcgtagatacatcgaatgggacaaatattttaattttgggaacagacggtcgtgttggcgaaagttcaggtgaaactcgaacggataccattatggttctaaatgtgaataacacggataacaaaatcaaacttgttagctttatgcgggataccttggtggatattgagggatatgaatataaactcaatactgcctatactttgggagaacaggataatcagcaaggggctgaagaagttcggaaggcgttgaagaataattttgacattgatatcaagtactatgcgatggtggattttgcaacctttgcgacaacgattgatacgcttttccctgagggtgtaacgattgatgcacggttttcaactattaatggtgaagtcgttagctcagtagaagtgccgaatgatttacagctggaagaaaatgctcctgcttatcaaacgattcaagtcggtgtacagcagatggatggtaagaccttgcttaactacgcgcgctatcgttcggatgatgaaggtgattttggtcgtacgagacgtcaacaggaagtgttatctgctgttatgacacaagctaaaaatccaatgaaactattctctggctccgaagctataggtaaggttgtggcgatgacttcgacaacagtgccacaaagctttatgtggctacagggaccaggccttctattggatgcggcaaatggtatcgaacgtgttacaatcccagaaaatggagactggattgacgactatgatatgtatggtggtatggctcttcgtgttgattttgaaaaataccagcagcgcttggctgagttaggcctgcgttaagaaatatggtatactagaagtgacttcggtcacttttttagtggttcaaaaatagaaagtagaattatgttaaagaaaaacgatattgtcgaagtagaagttgtagatttgacacatgaggggcagggtgtggcaaaaattgatggttttgtcttctttgtagacaatgctcttccaggcgagaaaatttccatgcgcatcttaaaacttaagaaaaatattggttttggtaaggtggagcaatggcagagcttctcaccagaccgtaatcaggacttggatttgacctatctaagaacaggtattgctgacttggggcatctcacttatccagcccaactagcttttaagaaaaaacaagtagagaatagtctacgtaagattgcaggcatttcagaaatagcagtagcagatacgttgggaatggacaatcctcttgcttatcgtaataaggcagctgttccagttcgtcgtgtgaatgggcagttagaaataggatttttccgaaaaaattcacatgatttagttccgattgaggatttttacattcaacataaggaaattgatgccttggttctagcgacacgtgacctcttgagaaaattagacttgaagccttacgatgagaaagaacagacaggacttgtgagaaatattgttgttcgtcgtggtcattattcaggtcagttgatgctagttttagttacgactcgtccgaaaattttccgtgttgaaacccttattgagcgtctgacaagccaatttccaaatcttgtttctatcgttcagaatattaatgaccagaataccaatgctatattcggtcaagaattccgtcttttgcatggcagtgaaactattgcagataccatgttgggcaatgaatttgaaatttctgcaccgtctttctatcaagtcaacacagaaatggctgaaaaactctatcagaccgccattgattttgcagaattgtcggcagatgatgtcgtgattgatgcctattcaggtattgggacaattggtctctcctttgcaaaacaagttaagcatgtttacggtgtagaagtcgttgaaaaggctgtccttgatagtcagaagaatgctgctcgaaatgggattgataatgttacctatgtctgtgatagtgcagaatccgctatgcaaaaatgggtggcagatggagtcaaaccaactgtgatttttgttgacccaccacgaaaaggtttgacagaaagttttatcaaagcaagtacttctgtaaaaccagagaaaatcgtctatatctcctgtaatgtagcaaccatggcgcgtgatattaaactttatgaggaattggggtacaaattgacgaaggtacagccgactgatttatttccaaatacgcatcacatagaagttgtgagtctattagaaaaacgcaattagattgtccagcttgctctcttgttttctggcaagctgcttcaaaggtccgcaggacctttgaactcccaaatacgcatcatgttgacagttgccacacctacaccaaaatcaaatgccaacaagcattgagtcgggtaatagcgtaagtagcgcaaggtcatgatgagctgctcttccatacttagacggcgtgggcgtcctccttttcggtgttgctcttgataagcgtcagtgagacaatcaagcatcagttgaaacgtcgctttttttaacacctatcaacaatttgaaattctctgagtttaattttaaggctttttcgtatgttgtttccatacctttagtataccacttttgagttaccgaacaagtctattgctaaacttgatgaaggttgtattgtctgttataatattggatattgcaagctttaagtgaaaggttttagggaagagattatcacaactcattttttattggttatgagacgatggtataaatgatagtctagtaaaagatttggagaaatgacttccctagaaagttaaatgtaaaaacaatatgaaaaaatacgattatctagttgttggtgcaggtctgttcggagcggtctttgctcatgaggcagctaaaaagggtaaaaaaataaaggttatcgaaaaacgagaccacattgcaggtaacatctataccaaagaagtagaaggtattcaagtccatgaatatggcgcacatattttccatacttctgaaaaagaaatttgggattatgtgaatcagtttgcggagttcaaccgctatacaaacacaccggttgccaactacaagggtgagatttacaatcttccattcaacatgaatactttcaataaactgtggggcgtggtgacccctgctgaagcagaagtgaagattgcagagcaacgggctgtattgggaggaaaaacacctgagaacttggaagagcaagccatctcactagttggtacagacatctatgaaaaattgatcaagtcctacaccgagaaacaatgggaaaaaccatgtacggagttaccagccttcatcatccgtcgtttgcccgtgcgtttgacttatgacaataactatttcaacgatagctaccaaggtattccaatcggtggttacacgcagattgttgaaaaaatgttggaacatgaaaatatcgatgtggagacaaatgttgatttctttgccaataaggaagactatttagctacctatccgaagattgtctttacaggaatgattgatgaattctttgattaccaacttggtgaattggagtaccgtagccttcgatttgagacagaagtgttggatatggaaaactatcaagggaatgcggttgtcaactatacagatagcgagacaccatatactcgaatcatcgaacacaaacattttgaatttggtacacaaccgaaaaccattattacccgtgagtattcgaagacctggaaacgaggagatgagccgtactatccagtgaacaatgatcgtaacaacaaactctatactgcttataaacgcctcgcagaacaacaagagaatgttatattcggcgggcgtcttggtcattatcgttactacgatatgcaccaagtcatcggagctgccttacagtgtgtgagaagtgaagttggggaatgattttgagaagtcatcaaagtagtaattgattcttgacagaagttggaatgctcttaaaatgttaatcaaaaaaaccagaatttctggtttttttgattattgaattgctgccaacaggtcagctgcttgttgttcgagttttgttcgagtttcgtcagataactccaatacacctgttccccatgcttctggattgatggttgaacctgtaaattcaccagcaatctgggtgcggataaatggaagaaggtgctggaagtctttgaataggtggtcgtgaccactgtttgcgacggcagagacagtggtgattttatcttgtaggatagatggtccttttggattggataaatcgagcgaacgactgagccaatcgagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatgtaagatacttgagccttatcagccaagaacgcttcagcttttttggccatttgatggttaaaagaaccgtcacgtagtgaaccaactaaaaacaatacgtttgccatgatggcctccttttcataaaaacataaatttagtatatcgtactcgtggtgctagttcatttcaaactacaataaaaagcccaaatggac

SEQ ID NO: 64 - DNA, 25190 bp, Streptococcus suis
ccctcaaaaagactagaaaattaggcaaaaaatagaagacagcaaaaaacgggacttttaatcccgttttgttttttccttgatccattgactgacgttggacagggccttgctttgctctgccttgcgtttttgttcgtggacaaaatctgcaaagctttgcttgacgccgtccttttgaaccttgtcctgcaaatcatgccatttctttttaaggttgctggaagtccgttcgtagtagtcttcaaggatttcttccttggacttgtaattgcggtagaaggcattgcgtgacacaccagcttttcggaccaattcagataccgaaatttgcttgagctcctttttctctaggagaaatagcagagcagtttctattgattccttagtcagttgattcgcttctttatttgattgatagaggtttttcaaagattggggtgaaattttacgacctgccatagttttccttttccgagtgtcacatctgaaagaaaatgctttcagatggggtagtttaatgatataattgtaagtaaatagagatttattgtcaaataaaaaagtaaaattggaaatgagaatattatgtcaaaatggaaaattgttgcagattcgggctgcgactatcgtcaattagctaatctagctccggacactgaatttattagtgtgccacttaccatccaagttggagaacaagcatttgttgatgatgcaagcttggatattgatcacatgatggaggtgatggaagcatctaagtctgcagcggggtcggcgtgcccaagtccgcaggcttatcaggtagcttttgagggagctgagaacattatcgttgtgacgattacaggtgggctatctggtagttttaatgcggcacgtgtagctagggatatgtatatcgaagagcatccgaatgtcaatatccatttgatagatagtttgtcagccagcggggaaatggatttacttgttgacgaaatcaatcgcttaattggtgcaggattagattttccacaattagtagaagcgataactcactatcgggaacacagtaagctcctctttgttttagcgaaggttgataatcttgttaagaatggaagactgagcaaattggtaggcactgtcgttggtcttctcaatatccgtatggttggtgaggcaagtgctgaaggaaaattagagttgcttcaaaaggcgcgtggtcataagaaatctgtgacagcagcctttgaagaaatgaaaaaagcaggctatgatggtggtcgaattgtcatggcccaccgcaacaatgctaagttcttccaacaattctcagagttggtaaaagcaagttttccaacggctgttattgacgaagttgcaacatcaggtctatgcagtttttatgctgaagaaggtggacttttgatgggctatgaagtgaaagcgtgattcacagagtaacaattttgggatgtaatttccactatagaataatccccctcgtcttctaagttcgagggggattatttgtatgagactattggatttcattcattcaaatatcttacgaattgctccagtttatctgcaaaatcttgttcaaagaagatctgtaagaaatcagctttctgtccgctgaaataataacacttttcaaacatgtgttggatgctaggcgaaagaatccccttgcttagctgaaaggtcacgctccctttggaaattcgataggggatgttcaaagcgtatttctctaaacaatcttttattttattccactgagcgtgataaatgtgatgaagatgttgtgtgttccgtgcaaacatgccgttatcaatgtagagcgagagagctttttgcatgataagattggtatcgtagtcgattagactcttatgtttgatgaaggtatcacgtagctgattaggaaggctgattgcaccgattcggagggcaggaaagagtgtcggtgtaaaagattttatatagatgacgcgattatctgtatcaagatagtgtaaaggtaggctatgactagagtcgaaatccgccaaatagtcatcctcaatgatgtagacatcgtattgctttgctaattttacgatggctgtttttgttgctatatcataagttgaaccgagagggttgtgcaagcgaggaattgtgtagaaaaacttaatttttccagtttggaagatactttccaattcttctaggtcaattccatctaaatcccgttcaattgtttgataggggattccttgatgtcgaatgagctctatcattcgtgagtaggtagggttctctatcaagatttccgtttttccagccaaggtttccatttgtgtgagaatatatagagcttgttgactaccagctgtgataaccagctggtctttttttgtatagacatgatagtccattaacagactttgaacggaggaaatcaattctgccaatccctcttgctggtgatagtagttgaataggtaattttcccgcccaataagactttcgtttagacaaattcgaaaatcttcatagggtaattcttgaaagtctgcaggattgagctctacagtaaggtcttggaaatctctatcttctaagatataataaccgcttttttcgacagcgtagatcttattttggtattttaattccaacatagccttttggacggtgtctttgctacaatgatattgctcgctgagctgacggatagaaggtaacttctctccacgtttgaatcggtgttcctctattccattcaaaatatcttggatgataacttgatattttttcatctaggcccccttttttatagactatgttattagctagtatatagtaaaaattgaagaaagacaatatatggataatggggttgaggttcaggaattaagctactctatggtataattaagtgatgaaaataattatacctaatgcaaaagaagtaaatacaaatctagagaatgcctcattttatcccctgtctgatcgaagcaagcaggttctggatgccataagtcaatttgatataaaaaagatggctgccttttataaattgaatgaagcaaaggctgagttagaagctgaccgttggtatcgaatcaggacaggtcaagcaaaaacctatccagcctggcagttatatgatggtctcatgtatcgttatatggataggcgaggtatagattcgaaagaagaaaattatctacgtgaccatgttcgtgtagcgacagccttatacggattgattcatccttttgaattcatttcacctcatcgcttagattttcaagggagcttaaagataggcaatcagtctttgaaacagtattggcgaccgtattatgaccaagaagttggtgacgatgaactgattctctcactggcttcgtcagaatttgagcaggtgttttctccacagattcagaaaagattagttaaaattcttttcatggaagaaaaagcaggtcagctaaaagttcactcaactatatcaaaaaaaggcagaggaagattgctgtcctggttggctaagaacaatattcagaaattatcggacattcaagattttaaggtggatggctttgaatattgtgcttccgaatcaacggcaaaccaacttaccttcatacgatcaatcaaaatgtgaaataatgaacaagataacgttttctgatgtcgagcgtatctagaaaaatcttgatttctatggtataatgggtaagttataagtaaaaaggaaggttgtttatgaaaaagagaagcggacggagaaaatcgtctaagctcaagttgataaattttgcgctttggggactttacgccattactctatgtctattcttagtgaccatgtatcgctataatatcttagatttccggtatttaaattatattgtgacgcttttgctagtaggagtggcagtattgactggattattgatgtggcgtaagaaagcgcgtgtctttacagcactcttacttgttttttcactctttattacttcagttggagtatatggaatgcaagaagttgttaagttttcgacacgactaaattcaaattcgacattttcagaatatgaaatgagcatcctcgtcccagcaaatagtgatattacggatgttcgtcagcttactagtattttatctcctgccgaatacgaccaagataacatcaccgctttattggatgacatatccaaaatggagtctactcaactagtgactagccccgcgacctcttacctgacagcctaccaatctatgataaatggtgagagtcaagcgatggtcttcaacggagtttttaccaatattttagaaaatgaagatccagacttttcttcaaaagtgaaaaaaatatatagtttcaaagtgactcagactgttgaaacagctactgagcaggtgagtggagatagctttaatatctatattagtggtattgatgcttatggaccgatttctacggtctctcgttcagatgtcaatatcattatgactgtcaatcgtgcgacacataagattttattgacaactactccacgagattcatacgttgctatcgcagatggcgggcaaaatcaatacgataaactaacacatgctgggatttatggtgtcaatgcctctgtgcataccttagaaactctttatggtatcgacatcagtaattatatccgactcaacttcacttccttcttacagttgattgatttggttggtggtattgatgtagaaaatacccaagaatttacaagtcgtgttggtggctactattttcctgttggtcaggttcacttaaatgcagagcaagcgctaggttttgttcgggaacgttactcacttgagggaggggataatgatcgcggtcaaaaccaagaaaaagtcattgcagccctcataaaaaaattgagttcaccagataatctagcgaattatcaagctattctaactggtttggaaggatctatccaaacagatttgagcttagaaacgattatgggcttggtaaatacccaattagagtcaggaacacaatttacagttgagtcacaagcattgacaggaacaggacgctcagatttatcttcttatgcgatgcctggatcacaactttatatgatggaaattaaccaagacagtctggagcaagcaaaggcagcgattcagtctgtacttgttgaaaaataaagattttaggagaaaatatgaacaaccaagaagtaaatgcaatcgaaatcgatgttttattcttactaaaaacaatttggagaaagaaatttttaattctcttaactgcagtgttgactgcggggttggcatttgtctacagtagctttttagtgacacctcaatatgatgcgacaactcgtatctatgtagtaagccaaaatgtagaagctggtgccgggttgaccaaccaagagctacaagcgggtacctatttggtaaaagactataaggaaattatcctatcacaagatgtattgacacaagtagcaacggaattgaatctgaaagagagtctgaaagaaaaaatttcagtttctattcctgttgatactcgtatcgtttctatttccgtgcgtgatgcggatccaaatgaagcggcacgtattgcaaatagccttcgcacctttgcagcacaaaagattgttgaggtcaccaaggtaagcgatgtgacgacacttgaagaagcagtcccagcagaagaaccaaccactccaaatacaaaacgaaatatcttgcttggtttattagctgggggtatcttggcaacgggaattatcttggctatggaagttttggatgaccgcgtaaaacgtccacaagatgtggaagaagttatgggcttgaccttgcttggtgtggtgccagattcgaagaaattgaaataggagaacaatatggcaacgttagaaattgcacgtacaaaaagagagatagtaaataaaaccgaggaatatttcaatgctatccgtactaatattcagcttagcggagcagatattaaggttgttggtattacctctgttcagtcaaatgaaggtaagagtagaactgcggctagtctcgctattgcctatgctcgttcaggttataagaccgttttggtggatgcggatatccgaaattcagtcatgtctggttttttcaaacctgttacaaagattacaggtttgacggattacttagcagggacaacagacttgtctcaaggattatgcgatacagatattccaaacttgaccgtcattgagtcaggaaaggtttcacctaatcctactgccctgttacaaagtaagaatttcgagaatttaatagctacacttcgtcgctactatgattatgtcattgttgactgtccaccgctaggattggtgattgatgcagctatcattgcgcagaaatgtgatgcgatggttgcagtagtagaagctgggaatgtaagacgctcagctgttaagaaagtaaaagaacaactggaacaaacagggacgccgttcttgggagttatattgaacaagtatgatgtggtcactgaaaaatatggtgaatatggaaattacggaaattacggcagaaaatgatttcctcttgatggtataagtttgataagtaggtattaatatgattgatattcattcgcatatcatatttggtgtggatgacggccccaaaactattgaagagagcttgagtttgataggcgaagcttatcgtcaaggtgttcgctatatcgtagcgacatctcatagacgaaaaggaatgtttgaaacaccagaaaaagttatcatgactaactttcttcaacttaaagaagcagtagcagaagtttatcctgaaatacgattgtgctatggtgctgaattgtattatagtaaagatatcttaagcaaacttgaaaaaaagaaagtaccaacacttaatggctcgcgctatattctcttggaattcagtatgaatactccttggaaagagattcaagaagcagtgaatgaagtgacgctacttgggctaactcccgtacttgctcatatagaacgatatgatgccctagcgtttcatgcagagagagtagaagagctaattgacaagggatgctatactcaggtaaatagtaaccatgtgctgaagcctgctttaattggcgatcgagcaaaagaatttaaaaaacgcactcggtattttttagagcaggatttagtacattgtgttgccagtgatatgcataatttatctagtagacctccgtttatgagggaggcttataagttaataacagaggaatttggcgaagataaagcgaaagcgttgctgaaaaagaatcctcttatgctattaaaaaaccaggcgatttaaactggttactctagattgtggagagaaaaatggatttaggaactgttaccgataaacttttagagcgcaacagtaaacgattgatactcatgtgcatggatacgtgtcttattacagtttccatgattttgagcaggctgtttttggatgttattattgacattccagatgaacgcttcattcttgcagttttatttgttttaatattctatctgattatctcagttagactaaaggttttttcgctaattaccaggtatactgggtatcaaagttatgtgaaaataggactgagtttaatatccgcttactcattatttttaatcatttcaatgattctatggcagacctttagttatcgtttcatcttagtatccttatttttgtcgtatgtaatgctcattactccgaggattatttggaaagtcttacatgagacgagaaaaaatgccattcgaaagaaggatagcccactaagaatcttagtagtaggtgctggagatggtgggaatatttttatcaataccgtcgaagatagaaaattgaattttgaaattgtcggtatagttgaccgtgatccaaataaacttggaacatttatccgtaccgctaaagttttaggaaatcgtaatgatattccacgattggtagaagaattagctgttgaccaagtgacgattgccatcccttctttaaatggtaaggagagagagaagattgttgaaatctgtaacactacaggagtgaccgtcaataatatgccgagcattgaagacattatggcggggaacatgtctgtcagtgcctttcaggaaattgacgtagcagaccttattggtcgaccagaggttgttttagatcaggatgaattgaatcagtttttcacagggaaaacaattcttgtcacaggagcaggtggctctatcggttcagagctatgtcgtcaaattgctaagtttacgcctaaacgcttgttgttgcttggacatggagaaaattcaatctatctcattcatcgagagttactggaaaagtaccaaggtaagattgagttggtcccgctcattgcagatattcaagatagagcattgatttttagcataatggctgaatatcaacccgatgttgtttatcatgctgcagcgcataagcatgttcctttgatggaatataatccacatgaagcagtgaagaataatatttttggaacgaagaatgtggctgaggcggctaaaactgcaaaggttactaaatttgttatggtttcaacagataaagctgttaatccgccaaatgtaatgggagcgactaaacgtgttgcagaaatgattgttacaggtttaaacgagccaggtcagactcaatttgcagcagtccgttttgggaatgttctaggtagtcgtggaagtgttgttccgctattcaaagagcaaattagaaaaggtggccctgttacggttaccgactttaggatgactcgttatttcatgacgattcctgaggcaagtcgtttggttatccaagctggacatttggcaaaaggtggtgaaatttttgtcttagacatgggtgaaccagtacagatactagagttagctcgaaaagttatcttattaagtggtcatacagaagatgaaattggaattgtggaatctggaattcgtcctggagagaaactctacgaagagttactatccactgaagaacgtgttagtgaacaaattcacgaaaagattttcgtcggtcgtgtcaccaataaagaagaagaggtcgttcaaacctttatcaatggtctcctattaaaagataaggaagaactgagaactgccttgcttgaatttgcaaaacaagaataaagaaagtaaaagttatttttactttcctagagtttaaacgatgtttaagttctaggaaggttggaatacctcaaaaagtgaacagatatgacccagttcgtagagttcggaaaaattagatatttacaaatagtttgtattgttgtcagattttatgagaagtttggttgacagaagttagaatgtttccgacattttaactgaacttttgtaaggctacaagaggagatgaagattatattatgggactaacattaatgtatattacgaatcagctagatgttgctttaattgctgaaaagtatggtgttgaacggatttgggtagatttagagactcttgggaaagcagaacgccaaaaaaatatggacacagtccaatctcaacataagatcagtgatataagattgatttctagcaaattgactacttcagagatgttagtgcgagtcaaccccttaaatgattcttccaaacaagaaattgagcaggttattgcgtcgggagctgacttaattatgttgccgatgtggcgaacaaaggcagaggtatctcaatttattgattttgttggtggtagagcaaaagttgttctcttattagaaacaaaagaagcatttaataaccttgatagtattttaacactgaatgggattgatgaaattcatattggattaaatgatcttcatttagatatgggactaacattcatgtttgaattactgacgaatggtgtagtggcagaaattacacaaaaactaaataaggctaaaattccatatggatttggtgggattgctagactggggttaggagagctgccagcagagatgattgttaaggagcattatagacttgggtcaactcgcgcaattctttcacgtagcttctgtaatgctgagaaagtgacagaattatcgaatatagaggatatttttagaaatgagttaagaaaattaagggaatttgaagaaaatttatcagagttaaatgacgcagaatttgaagaaaattttgaaacgatgcaaaaaaaaatagatgtgattgtgagaaataaaaagaaatgaaattatacttaattgttaagagaatttttgatattttagtatcagtagtgggaatagttgctttatcaccagtattattattgacctatctagcgattaagttagattctcccggaccagctatttttaaacaaaaaagattaggaaggtatggaaaggaatttaccgtctataaatttcgctctatgactgtcggtgcagagaaaatggggtcaggtcagtactcgtttgaaggtgatccacgagttacaaaagttggtaattttattcgtaagacaagtattgacgaattgccacaatttatcaatattttaaaaggtgatatgagtttaatcggatttaggccgccacttacttatcatccaaaaacgtttgaagaatacacagatgcagagcgagtgatgttttcgcttcgaccaggtgttactggctgggctcagatacacggtcgaaaaacagtaaattggaatgaacgaattcaaatgaatatttggtatgctaataatattagtttttggcttgatgtgaagattttttttacaactattatcaaagtattgaagaatgaagataatattaatacgaataaaacggtttaaaggagttttatgtcacagttgcatttatcaatagaagaaatatcaggaaaacttactagtctttttgtagaggcaggactgtcagaagtagatgcagaaattatttcgaaaaatctgattttgactgaagcaggcggaatcgaatcgcatggtataagaatggttttaccgcatttaaaacgtgtcaaagaggggaaatacaatcttacaccatcgatgaaagttctaaattcgtctccctcatttacagttgtagatgcggataatggagttggaatgtatactgcaacaaaggcaatggagattgcaattgaagaagcagaaaaatatggaatgcatacggtcttttcacgcaatgcgaatactttcggagcagcgtttacatatacaaagatggcatcggataaagggttaattggggttgcctttagcaattcacctgcagcaatggctccatggggagggaaaaagccgttaattggaactaatcctatatccattgcaatcccaggagagcaagagggaccgattttattcgatatggcttctagcaaggtggctaagtcaaaaattggaatcgctcagaagctaggtgaagatattccagaaggttgggcacttgataaggatggaaatcccacgactgaccccaattgtgcactatcaggaacagtacttcctttggcagaacataagggatatggacttgcactatgtttagacgtattatctggtgttattagtggggcagcatttgctgatactgtaaataaattttatagttctgaacagacgcagtctggtatgaatgttggtcaaacatttattgcaatcgatcctaagcaagttttaggaagtgagttttaccaaaaaatggatacatatattagaaaaatccattctgaagagaatgtaaggtatccaggcgagggaactgttagaaatttgaaaaaatcaattcgcgatggaatattaattgatactgaatttgttcgtatttttgaagattaagagagttagaatagattggatagtatgaaaaaagttaatactttgagagaactgcaattaattagtatttatatttacaaaacgttaatggagttttgcagtaaaaatgacataaatgtatacttacatggaggctctcttattggagctattagacatggtggatatattccgtgggatgatgatattgatatttgtatgagtcgtacggattatgaaaaattgatagcactttctggtggtaaaatttcttcagattgtaaaattattgatccggcaactaatcctgattttaacggttatattcctgttattgtctatgaacattcaaaaatgaactcaaaacaatataagataccagaagacttaaaaatcggtatcagtgtttttgtatatgatggtattagtgcaaatccttttattcaaaaattatactatgcacgtatgtttctgttgcgagcagagcatgcactttgcagagctgatttcaatcacgttcatacttctattgcaaaacgttttggctttttcttccaaagattctataaagcgacaaacgttgaaaaatataaagtaaaaattttgaaattgcaacagaaatataactatgaaacttctgaatatgtttcaacaaatgcagattatcaagcttcaaaagagatttgtctaaaaacagattttgaaagtgcagtaccgttagagtttgaaggtattgctagctatacctactctcattttgattcccatctaagagaatattatggtgattatatgcagttaccacctgtggaacagcaggagccaaaacatggatttgaagcatgggttgatgaagattttgatttcgagtttttaaattaattgagaatcgtaattgggagggaatactatgtatttattgatgagattgttcatctatctattgccatcaggtgttattagaacaaagtggattgaaaagtttaatatttttggacaaacgggaaaaaatttttatttttgtcctaggaaaatcccagcagatccaaaactgataaaattccatgacaatgttgcagtggctacagatgttatgtttatcaaccacgatgtgtcgcaaaaggttttcaataattataaagctgagaagttacctaaattttatggatgtattgaaatcgggaataatgtatttataggtgcaagagcgactattttaccaaatgtttcgatttgcgacaatgtttttatcgctgctggtgctcttgttgcaagctcgattacagaatctggaatttatggtggtgtaccagctcgaaaaattggtgatatggatgaactttatgaaactcgtctaaactcttataagcaatttgttgaacaaaaagaaggtaaggagttgcatgaagcgatgtggagtctatttgagtctaaaaaatagaggactacacgttagattgcatataattgaaaatgaaaaaagttttattaataaattcttgtcagggattgtatggtggtatagagtcatttcttttaaatatatttaatagtttatcaccggcggaatttgatgtcactttcttgacttgcggtaaaacaacatatgatatgtataggaatgatattgaaaatagaggaggtcatattgatgaaatccctatttttgcagataccttatctaaacaagtgaagctgtataaggccttaaaggaatattatagtgaaaatcaaccggatattgttcacattaatagtggaggtctatccttccattatctagcttccagagctgctaaagcggttggaataaaaacagttatcttacattctcataattttattccagaaaaaagtggttttaaggaaaaattgaaaaatttcatgaagaggcaagtcgctcgctatggagatgtttatttagcttgttcaacaggtgcagcaaggtggattttcccagagaatctagtagaatccaatagtgttgaaattattccaaatggaattgacacggtcaaatttgcatatagcttggagaagcgacaatcttttagaaatgaatttggaataggaaatgagcttttaattggtaatataggacgttttcaagagcaaaaaaaccatccattcatgctgaaaataatggcagaagttatcaaaaaatctcctgacgcgaagttaatgttggcaggagagggagaactaagaaaaactattgaagaacaagttgtagagtatggattagctgaaaatattatatttttgggtgagcgcaatgatatggatagatttttctccgcaatggatgtttttattttaccatcgttgcatgagggattgccatttgcagctattgaagcacaagcttcaggtaccacggttttacttgcggacactgtcactgtagagacaaatgttacaggaaacgttagttatttaccgattttttctgatggtagcgagttcttatgggcggaagctgtattgaaagagttacctagggaagactataggcatcagcaaaataaaataatgcgacagtctccctataacgtcgaagtttgttgtcagatgatgaggaatatttatttaggagttcaaaatgttagatagatatttgcatatgttttcgtggggagtgctctatgccaccttcagtctatgtttagtctctctatatagaactttgcaaaattctgagacagttctttacttgtcacgaaacaatggaaagaagcaaccgctactacatagttcagatgcgattatctatctgataatgacaatcgtttctgcaatacggttaaatacaggatccgatttttataattattatacctattttgaccaaatattgatacgatataactcatttgaagaagtcttttttcaatcacagagtgggtattttgctttatcctacatcattaagcaaattacagattatcagtacgctatttttgcagttattgcagtattttcatatgcttaccttttttatttaatcagatcagaggtagaggatacaacaagtgcattgttaacgtatatgtttcttggctattatgcatattctaataatatactaaagcagtatattgcaatgaattttgtaatggctacttacctcgctttgagtagaagaaaatattttaaaacgatactgtttgctgtaggggcaatgctttttcattactcttctgttttagttctggtcattttattttttgcgtcacgattcaaacctacgtttaataaatattacttggcaatagtaggtgggctcgtagttgctttaaacctaaatactttatttgcaatattttttaaattaattccttctgcttctggttatgaaatttatgttaattggcgacgatcagatcaaatacgtctagtactggctgtactaggaatggcaataatgcatgggatacttatttattatattttaaagtataaagataaaatcaaaaagcaagatgaaaggcgatatcgtgaaattatatttctaataatcggacttgcaataaatattttatctattagacaatggattatcaatcgtattgcggtttatttttatcaatttatcattttgattctaccaacgatgttttcatcacttgaagttgaaaataagaaacgtttaaaaatagtattatatattatcatgtttatttatatgattttcattagtatatttttaggagagaatgagtattttagctataatacaatttttagtggagaccagccaatatcggatgttatctacaatcagattcatggatggacaaaatgattatggaaaaacagagtagaacaagaaattcattaatcaacattattacagcagtctcaggtcaaggtatagggataattgttagttttgttgcaaggattatatttattagacaattaggcgaggtctatttagggataaatagtctgtatactaatattgttggtttgctttctctagctgaattaggggttggcactgctattaattatagtttatataagcctttggcagaaaatgatattcctgcaataaaaagtttgatggctctatatcgtaaagtttatacagtaattggatttattattctaggaatcggtatattcttattaccatttttagatatgtttatgaaagcgactgagacctcagagattccacataaacatctaatattttttctatttgttttaaattcatcagtatcatatttttatagctttaaaagagcattagttatttcagatcagaaaagatatcttgcgacattatatcgttacattttctttgtattaatgaatgttcttcaaattatcttcttaattctaaccaaagattttattatatttttgcttattgcactatttagtacagtacttgagaatattttaatttcaaggaaagcggatcagttatatccgttcttaaaagaaaaagatattgaaaaagttagtaaagagacaacagacagcattaaaaagaatacagttgctcttttatttcacaaagtagggagttctgtagtcaattcgacagataatattttgattgcacaaattattggaattgtcgctgttggggtatactctaattatcaactgattataaatgctctcaatattgttattgcacagtttttcatggccctgacagccagtatcggtaatttaggtgcaacagaaaatgttgaaaagtcagaaagcattttttataaaatattctttttaaatttttggattgattgcattatatcggtctctatttttgcttgtatcgatttattgattggttcatggtttggtaatcatttgatacttgataagttggtgttagctactattgtgataaatttttatatttatcaaattcgtagaacggtcatgacatatagggatgcttatggtttgttttggaatgataggtacaaagcattggccgaagcgattttaaatattgttatttcaatttatcttggatttaaattagggttagttggtatttttttgggaacaattatcagtacaacaataacaagtttatggattgaaccatatattctgtttaaatatggtttgaaacgttcgactgtgacttattttaaacgattagcgcagtattcggtcatcactttagttgcaagtttggtgtgtagttatttagttaccctatttcactttaatggctttttggggtttattcaaggagttgttctaagtgtggtagtcgtttcaagcgtcatttcattattattttggaaaactgaagaattccaatattttaaaaaattacttttaaaatttcaaaatatgattttaaaatacttgaaaactagtaggagctagataattattaacaatagaatttctataagttttggcatttaaaggagagaatatgataaatttttcagttggtcctgtattaatggatgaagcaacgcgtgctatcggttcagaagagataccttattttcggacagatgcattttctcaaattatgtttgataacgagaggatgatgaagcagctcacgtcggctgatgaaaaaactaggttaatcacattgactggttctggaactttagcaatggatgcaactattttaaattgttttaccaaaaaagataaattattaattatcaatggaggaagttttggtgcaaggttctgcgaaattgcagattgttatagtataccatttgaaaccattgacttacaatttggtgaggaattgacagtagagcattttcaaaatatcgagttttcagattttacaggactggttgttaatgcggatgaaacgtcttcaggggttctttatgacatagaaatgctcggcaatatttgtaaggaacataacttgttttttgttgtggacgccattagctcatttttagcagatccaattaacattagtagtgctcggattgatattttgattgcaggttctcaaaaggcattagcgcttccacctggtgtctctttgatattatgttctgaaaaagctcaagaccgcattaataataatctcaacccaacttattaccaaaatttaaagagagcattaaaagatggtgaaagaggacaaactcccttcacacctgcagtcggaattatcttgcagttacatgaaaaattattgcgtctttctcaaaaaggtattgaacaacaaattcaaaagacacaagaattagcaacctattttagaaaaaaagtttctcaatataattttgaatttgttaccacttctccatcaaacgcagtcacggcgctacgtgtacctgaaggggtctcagcaaagcggatttttcaagaattggaacatcgttttgaaatatggatttgtccaaatggcggagaattaagtgataaggtttttcgtgtcggacatatcgggaatctgcagaaaacagactacgatactctattcaatgcacttgatcagttaaaaaaggaaggtattattagataatgaaaattattttacttgctgctggaagaggtacaagaattagtcgttatattcaagacagacctaaatgtacagtgaacttgacggagaaacagacattaattgagtatactgtatctatgtttaatcgatatggttttgatgatatttctataattcttggttatcgtcaagatgtgattagagaagtattaaaagattataatgtgaaattctactataacccattttacgatgtaacaaatagcattgcttcgttgtggtttgctagagaagagttgaatgatgatttattcatcatgaatgctgatgttttcctagataccaaaacattagataagattcttagtgagaaaaagtcacctgtcctgttttcggacgaatcaagaaaagaagaagccgattataaattttattatgaagctgaaaaattgataaaatatggtaaagagctatctgttgaagaaacaacgggtgaatatattggtgcagcgattattaataaagaatttttaccaaaatttaatcgaactctccttaacaagattaacaaccaagagcatggacaatggtgggaagaaatactgtattcaatgacaagagatgagtctatttatgtttcttctgtaacaggtaacttttgggcagaagtagattatatagaggactatgaaaatatcatttctttcgtgaaaaataacagtatttgagctctttatcaactgtagtgggtaaatgccagctaacacatagagaggacgaacttcgttctctctttttttctatactcaaaaaggctccataatctctacagtggatttactcactacagaaattatagagccgaaaagacgatttcctagtttggaagtcgccttttttgatgttttcgaaatactacatattgttgttagtgtaaacatatatatagttttaaaaattttttagtaaatgtttttagagtttttatagtcgaatgaattagctttcagacaaggaactgaggcgcaggctgtactagagtacggcaagtcgaaagtgacgatgtatcaaagctaattcaaatgactatatattatttatttcctactattctctctattattgctaaacttgatgaaggttgtattgtctgttataatattggatattgcaagctttaagtgaaaggttttagggaagagattatcacaactcattctttattggttatgagacgatggtataaatgatagtctagtaaaagatttggagaaatgacttccttagaaagttaaatgtaataacaatatgaaaaaatacgattatctagttgttggtgcagggctgttcggtgcagtctttgctcatgaggcagctaaaaagggtaaaaaaataaaggttatcgaaaaacgagaccacattgcaggtaacatctataccaaagaagtagaaggtattcaagtccatgaatatggcgcacatattttccatacttctgaaaaagaaatttgggattatgtgaatcagtttgcggagttcaaccgctatactaacacaccagttgccaactacaagggtgagatttacaatcttcccttcaacatgaatactttcaataaactgtggggcgtggtgactcctgctgaagctgaagcgaagattgcagagcaacgggctgtattgggagaaagaacacctgagaacttggaagagcaagctatctcactagttggtacagacatctatgaaaaattgatcaagtcatacaccgagaaacaatgggaaaaaccatgtacggagttaccagccttcatcatccgtcgtttgcccgtgcgtttgacttatgataataactattttaacgatacttatcaaggtattccaatcggcggttacacgcagattgtagaaaaaatgttggaacatgaaaatatcgatgtggagacaaatgttgatttctttgccaataaggaagactatttagcgacttatccgaagattgtatttacaggaatgattgatgaattctttgattaccaacttggtgaattggaatatcgtagccttcgatttgagacagaagtgttggatatggaaaactatcaagggaatgcggttgtcaactacacagatagcgagacaccgtttactcgaatcatagaacacaaacatttcgaatttggtacacaaccgaaaaccattattacccgtgagtattcgaagacctggaaacgaggcgatgagccatactatccagtcaataatgaccgcaacaacaaactctatacggcctacaagcgccttgcagagcagcaagaaaatgttatttttggtggacgtctgggtcattatcgttactacgatatgcaccaagtcatcggagctgccttacagtgtgtgagaaatgaagttggggaatgattttgagaagtcatcaaagtagtaatcgattcttggcagaagttggaatgctctcaaaatgttaatcaaaaaaaaccagaaagtctggtttttttgattattgaattgctgccaacaggtcagctgcttgttgctcgagttttgctagagtttcgtcagataactctaatacacctgttccccatgcttctggattaatggttgaacctgtaaattcaccagcaatctgagtacggataaatggaagaaggtgttggaagtctttgaataggtggtcgtgaccactgtttgcgacggcagagacagttgtgattttatcttgtaggatagatggtccttttggattggataaatcgagcgaacgactgagccagtcaagagcattttttacgatgcctgggattgcatagttatatactggtgagaaaatccagatagcatccgcagcgtctacttgtgcacgtagctctgcaatttcaggaaggataggtgtctcgatgtcttggttgaataggggaatttttgcaagatcaatataagatacttgagccttatcagccaagaacgcttcagctttttttgccatttgatggttaaaagaaccgtcacgtagtgaaccaactaaaaacaatacgtttgccatgatggcctccttttcataaaaacataaatttagtatatcgtatttgtcttttgttggcaatcctaggtctgctggttcttgaattttttaagtatttcggctaattggtcttgttcttctgaactaaggacagaaaaaatctctccaacgtgatcataatgctctggaaggattttttcaatggtttcgcgtccaagtggagtgagagcaatcaaggaagcacgacggtcatttgtatcgacagtcttgtagatataaccatctcgaatcatgttttttataacgacagtcatgttgccagaagtacttaataatttgtcaattaagtcttgaatccgcagatttcctttgttgtagagtgcctccatcactccaaactgacaaactgtcagtccgtattttttgattgtttctaattctgattttgtgatagtattagctgctctgcgaaagacgactagactgtgaagtgcatgcttgttctcgtttaaagattgttcaacagttctcatgagaatattttagcaataaatagttcggttatcaagcaaaaaaagttaaatcctatattcataggtaaagtaggttatatagcatagaggagctgaactgtgggtcccagttcttatatccgttcgctgtctaaaggagaatgaaagtttattcacaattcaattacggaaaaaatggaaatatgctttaacttgtagtataataggactactatggaaaaaaagatttttcaacttttggaagtattggcaacgaagaagggacagctgatagctggttcctttatactcctaagtgtcatgactttttcgatattcgttatttgggaccttgcagctaagcctttttctgatgtacagaatcacgctatttctgtagctcgagactatacggatatagaggttgttgatgatgtctctatctacaacgggacagaaacatactttagcgtgcaaggaaagacgagtcagggggaaatgattgcggttatcattcctgaagagacaaatactgtgtacgtttatccaatggcgaatggtatttctaaggaagaagcgcaggcagttgctacagagaatggtgctggagagatagaaaaatcggttcttggctacagagatgcgaagccgatttgggaagtcaaatcaggcactgcctactatttagttgaatttgaaacagggaactttatcaaacgggagggcttatgagcaagttatcaagacgagtcttagagatggaagaaagtgtaactctggcagcaggtgcgcgtgcaaaagccttgaaggcggagggacgtgatattttagagttaaccttgggtgagccagacttcgtcacaccgaaaaatattcaagaagctgctattaagtctatcgaagatggtaaggcgagtttttatacggtggcttcagggcttcctgagttgaaggacgcggtcaatacctactttgagaatttctatggctactctatcgaacgtaatcaagtcgttcttgccacaggtgccaaatttgttctctatgctttctttgcggcggtcatcaatccttgtgatgaggttctgattccaaccccttactgggtatcctatgctgaccagatcaagatgaacgaaggcgtgccagtctttgtcactgccacagaagaacataatttcaaggtaacggttgaccagctggaagcagctcggactgacaagaccaaggtcctcttgctcaatagtccgtccaatccgacgggtatgatttacagtcgtgaggagttggaagccatcggaaactgggctgtggagcacgatattctcatcttggcagatgatatttacggtcgtttggtctataatggaaataccttcacaccgatttcaagcatttcagaaagcattcgccagcagactattgttgtcaatggggtggccaaggcctatgccatgacaggttggcgggttggatttgccgttggtaatcctgagattattgcggccatgagcaagattgtcggtcagacgacgtccaacttaacaactgctgctcagtatgcggccattgaagcctttacaggtccgcaagatacggtcgaaaccatgcgtcaggcctttgaagagcgactcaataccatttatcccttactagcagaagtaccaggttttgaagtcattaagccagaaggagccttctatctcttcccaaatgtcaaaaaggctatggagatgaaaggctacacagatgtgaccgaatttaccacagctattctggaagaagtaggagtagccttggtaacaggtgcaggatttggagctccagaaaatatccgcctcagctatgcgactgatatggacacgctcaaagaagcagtggctcgactacacacatttatgaaaaaataaaaagaggaaaaataatgtctagaaaattgattaccatcaaccaagtaaaagattatgtcggtcaagaagtgaccattggtgcctgggttgccaacaagtctggcaagggcaagttggctttcttacagttgcgtgacggaactgccttcttccaagcagttgctttcaagcccaacttcattgaaaaattcggtgaagaagcgggtacggaaaaatttgaagtggccaagcgtcttagtcaagagacttctgtctatgtgacagggattgtcaaggaagacgagcgttctaagtttggttacgagttggatgtgacagaccttgaagtcatcggtgagtcacaagactacccaatcacaccgaaagaacacgggacagacttcctcatggacaaccgtcacctctggttgcgttctcgtaaacaggttgctatccaacaaatccgtaatgccatcatttatgcgacttatgaattctttgaaaagaatggctttatcaagtttgatagcccaatcttgtctggaaatgcggcagaagattcaacagaattgttcgaaacagactactttggtcaaccagcttatctcagtcaatcaggtcagctttatcttgaagctggtgctatggcacttggtcgtgttttcgacttcggacctgttttccgtgcggaaaaatcaaaaactcgtcgccacttgacggagttctggatgatggatgctgagtattcattcctcagccatgaagagtcacttgacttgcaagaagcttatgtcaaagccttgattcaaggtgttatcgaccgtgctccacaagccttggaaactcttgagcgtgatgtggatgctctcaaacgctacattgcggagccattcaaacgtgtggcttatgatgatgctattacccttcttcaagagcatgaagctgatgaagatacagactacgaacacatcgaacatggtgatgactttggatcaccacatgaaacttggatttcaaactactttggtgtaccgactttcgttgttaactatccagcaagcttcaaggccttctacatgaaaccagttcctggcaatccagagcgcgtgctttgtgcagacctcttggctccagaaggatatggtgaaatcatcggtggttctatgcgtgaggacaattacgatgccttggtagccaagatggacgagctcggtatggacaagtcagaatacgaattctaccttgaccttcgtaaatacggttcagtaccacacggtggtttcggtatcggtatcgagcgtatggtaacctttgtcgctggtacaaaacacatccgtgaagccattccgtttccacgtatgttgcaccgcttgcatccataa

SEQ ID NO: 65 - DNA, 25267 bp, Streptococcus suis
aagcccaagctagcaaagtaacgactaaaagcattttgtggaaacttcccctaacctttttacttcttgcatgtttttctctctattttccggagattttgggaaatggcggagctttagcacaagctgtttttgatgggatgggtgtgtggtatgccttagcttgcgtggttattaaagctgtacttgttttgctgacgctgaaaaatggggcttacggaggtactctgacaccatcattttcaataggcaccgtcctaggattcttgattgcagtgctgtgtcaggttgcttttccagagttatcgctaatttcggctatgttaattggctcaagtatctttttagccattaccatgaatgctcccttaacagctgttggcttggttgtgtcgtttacgggacaatctctcacggctcttccaattttacttcttgcagtcatcgtagcctttgctacaaaaacgattattgaacacattgaaaggaactattatgtcaattcatatcgaagccaaacaaggcgaaatcgcagataagattttacttccaggagaccccttacgtgccaaatttatcgcagaaaacttccttgaggatgccgtatgctttaacaatgttcgggggatgcttggctatacaggaacttataaaggtcaccgtgtttccgtgatgggaacaggtatgggaatgccatccatctctatttatgcgcgtgagttgattgttgactatggtgttaacaaattaattcgtgtcggaacggcaggttctattgatccagatgtccatgtgcgtgaactggttcttgcccaagctgcagcaacgaattcaaacatcattagaaatgatttcccagaatatgattttccacaaattgcggatttcaaacttttggatactgcctaccacattgccaaaaaactagggatgacaacacatgtcggtagcgtcctgtcatctgatgttttttactccaatatgccagaacgtaacatgaaactaggaactcttggtgtgaaagctattgaaatggaagctgccgctctttactatcttgcagcccaacatcatgttcaagcacttggtattatgactatctctgacagccttgtccacccagaagaggatacaactgctgaagaacgtcaaacaactttcaccgatatgatgacagttgggctagaaacgctcatcgctgactgatgtctcacaactatgaacacatagacatccttttggatgtctatgcttataatcacgcttggaaaatcgcagagcaagttccaaattttcctgagcaaagcctctatcttctggaaatgctgaaagagcgcagagagttaaacattgactttgtttttaaacataggttagaaaatcaaacaatcaaagacttttacaactttgagttgatttctaacgcctatgaggaagaacttttagccaattatatctttgatcttgaagccaaggtcaaaaatggagaaatcatagactttgtccgctcagtcagtcctatcttgtacagattattttttcgcttagtgcaaaaagaagtaccagatatcagacaatttattcatgatgccaaaaatgatcaatatgacacatggcttttcttgaaaatgaaacagagtaactaccaaatttttaatgactaccttaaaattcgccgtgatggtaaagtaacctctaaaagcttggctgatttcttacaatttactagccttcctaaacctattaagaaattaattttggaacttagagactttgaaaaatctgttcgcaatccacttgctcaccttatcaaaccctttgacgaagaggaattgcatcggacaacaaacttctcatctcaggcttttctaaataaaatcatagatttggcaatctttgctggaatacattacgatcggaaacacttttattttgacagagttaatgctatcatcaaagagaatctagctattgatcatttttaacaatctaacattaacagtaaattattatagtatgcctacacaagagattttacatccttacaaaaagcgccattccagtttagttggagtggcgcttatatatattaaagccttaatttttttcaaaacaagccagtcaggcaaggtttcgagtttcaaggaggattagattagtcggcatcgaatttaacctcttcaagtaagtattcaataaagcgctctcccatcttagaaagattggctttttcatgacggatatagacaatgtcaatcatatcttcaacatcaagtgggatagacacgatattgtcgccgttgaggttgctattgaggatcccggttgcagttgtgtacccatccagtccaatcaaaagattgaacaaagttgcgcgatcgctcacgacaatagactttttgtgaggaatctgggacataatttcttctgaaaagtagaaagaattgtgaatcccttgatcgtaactcaaataaggaaaatcttccaaatcttcaagcgaaaccatctgacgatcagctaaaggattaaatttgctgacaaaaatatgaggacgtgccttaaataaactcgtgtaggtcaaatgactatcatcgaacaacttagttaggacatcgcgattataactgtttaaaaagagaactccgatttctgaacgaaagtttttgacgtcatcaataatttcgtaggttcgtgtctcacgcaaaaaaagctcatactgagacatatcagttccttttaacaaggaaacaaaggcgttgacaacaaaagcatagtgctgagccgatacgctgaaaagttcacgcgtagtcgtcttacttttataacgctcctccagaagtgctgtttgctcgatgatttgacgagcgtaggataaaaattcaaccccatccttggtgagagtgattcccttaggattacgaataaatatctcaattcccatctctcgctcaaggtcacgaacggcattagaaagactaggttgagtgataaacagctgtttggcagcttcattcatacttcctgtttcaacgatttttataatgtagtgtaattgttggattctcatagcattagtttagctcaaaagtccaattgtggcaagcttttagaccccttttaataaaaaaagaagtatattatatttgtcatgaaaatgtaacaaatactgtcagaaagtttctaacttgtcatgaaatactgatttaaaggggttttggaaattatttaaaaaattaaaaaaactataagaatttttaaggaattgaaaaaatatgagttaaatggtatattagactatggattaagatatatttaagaaatggggactgtaatgaccaaacgttcacaaagtcgaaagaagtcaggtaaagtatctgccactgccatgattatcaatcttgccttgttagcactcttcactgttttagggggagttgttatctatatgacatatcgatacaattttctggctttccataatatcaatgttatttatacaggagttttggttgctatctttatcttgagccttctcgcaatcatattcaagaaagctaaggttctaactggaatcgtcctggtttttttcacaattttgacaggtgtgacactttttggatttaaatcggctattgatgttactagtaaatttaatgagactgcttcctattcagaagttgagatgagcgttgtcgcattagctgatagttcactaaatgatatttcagaagtaacaagcttgcaagcacccacaggagctgacaagaataacattgacgagttgatgacacaaattcgtacagacaaaggtttggaattgacaccagaatctgtagattcttatcaagtggcctatgaaaacttaaaaaatggcagcagtcaggctatggttctcaatagtgcttactcaagtcttttagagatgaactatccagactacgcctcatcactaaaaactctttacacttacaaaataactaagaaagtgacgagtgacgccaaacaagcaaatgctgactctttcaatatttacattagtgggattgatacctatggctcaatttctacagtatctcgatcagatgtcaatatcattttgactgtaaatatgaatactcataagattctattgacaacgaccccacgggattcatatgttaaaattccagatggtggaggcgatcagtatgataaactcacacacgcagggatttatggtgtcgaaacttctgagaagacactcgaaaatctttatggtattgatattgattattatgcacgtatcaatttcacctcattcttaaaattaattgatcttgtgggtggtgttgaagtttataatgaccaagccttcacaagttatacaaacaataaattctcatttgaggttgggaatattactctgaagacaggggaggaggctttagcttttgttcgagaacgttactcactacaaggtggagataatgatcgcggtaagaatcaagaaaaggtcattgctgctcttgtgaacaagttagcttcgctaaattcaatttctaacttctcagctattatcaatggcttacaagattctgttcaaaccaacatgccactagatgcaatgatgactctggctaatactcagttatcatctggaagtaagtttactgtaacctcacaagcagtgactgggacaggatcaacaggtcaattaacttcatacgcaatgcctacagctagtctttatatgatgcaacttgatcaaacaagtgttgcaacagcttcacaggctatcaagaacacgatagaaggaaaataagtatgattgatattcactcgcatatcgtatttgatgttgacgatggcccagatacacttgaagaaagtttagcacttattaaagagagctattcacagggcgtcagaacaatcgtctcaacatcacatagacgaaaagggatgtttgaaacgccagaagaaaagatttttgcaaatttttcaatcgtcaaagaaaaagtcgaaaaaatttatgatgatttgacactttgctttggtggagaactctactacagcaatgatatcccagaaaaattatctaaaaaccaagtacctcggatgaatgggacacgctttgccttggttgaatttagtatgacaacaccttggaaagaaattcatacaggactcagtcaagtattgatgcagggagtaacacccatagttgcacacattgagcgctataacgctttggagttcaataaagaacgtgtcaaggaactaatcgatatgggttgctatactcaaatcaacagttctcacgtgcttaaaccaaaactttttggagataagtataaagtcttcaaaaagcgtgctcgctactttttagaggaaaatttggttcattgtgtcgccagtgatatgcacaacactggtgagcgtaaaccttacatgaaagaagcttatcaaatcatttttaaagattttggtaaaaaacgtgcccatgatctttttaaagataaccctcaaactttgttagaaaataattatctataaataggagaaactatgaacacgaaagacaatgctagtattgaaattgacgttcttcagctcttgaaaaaactttggagcaaaaaatttctaattatctttgtagctttattctttgcaacactcgctcttttggctagtatctttttgcttaaaccaacttatacagccacaactcggatttatgtggttaatcaagccagtgaaaacaatatcacaagtcaagatttgcaagcgggaacctatctggtaaatgactacaaggaaattatcaagtctgtagaagttttgtcagatgtactagcagaggaaaaatcagacctgtctacggcagaactctctaacatggtatcagtttctattccaactgatacacgtttgattgccatttcagttgaagatcaagatcctaaggaagcagcgaaattggctaacagcatccgtaagctttcttctgaaaaaattaagaatgttactaaagttcaagatgttacaacacttgaagaagcagaagttccagataaaccctcttcaccaaatatcaagcgaaatgctgtattaggtgctctagtaggagcattcttggctatcgtaggtgtcctacttggcgaagtcttggatgatcgtgtccgtcgtgcagaagatgttgaggatattttaggattgacattacttggtatcgtgccaaatgctgataagatgtaaggagagaagaaatgccacaatttgaacttgtgagagcaaaagctcaaatgtttaaaaagaccgaggagtactacaactctatccgtactaatatccagtttagtggtcgagatttaagagttttagcgctgacctcagtgcaacctggagaaggaaaatctacgacatctgttaacgttgcggtttcttttgccaatgctggcttccgtactcttttgattgatgcagataccagaaattctgtgctttctgggacatttaaggcaaatgaacgctatcaagggttgacaagtttcttgtcaggcaatgcagaattatcagatgttattggtgacaccagtgtgcctaatctgatgattatcccagcaggacaagtaccaccaaacccaacctcactgctacaaagccaaaatttccaaaggatgattgaaaccattcgtggtctctatgattacgttattattgatacaccaccagttggattggttattgacgctgctatcattgcacacaatgcagatgcgagtcttttagttactgaggctggcgctgttaaacgtcgctttattcaaaaagcggttgatcaattagaacaaagtggaacacaattcctaggtgttattttaaataaagtagataatacagttgatagatatggaacatatggggactatggctcatatggtgcatatggaaaaaaacataactcataataaattatattttttaatgcagagaggttttcatggaatacgcttatttgtttataaaaagactttttgacataatagtttcattaattgttattggatttttagttatagttactatctttataaaaattatttatctactatatggagacactaaatctattttttactcacagaatagagttggaaaaaatggaaaattatttaaaatgtttaaatttaggactatggttcctaatgctgaagaaattttaaaagagattttgaaagatcctgtcttcaaagaagaatgggaccaatatcataaattggaaaaagatccacgtattacaaaagcgggcaattttctaaggaaaagtagtttggacgagctacctcaatttataaatgtgctattcaatcaaatgagtcttgtgggacctaggcctctaacacctggagaattggattatcataatggtgaccatgatatatatgaatctgttaaacctggggttacctcttggtgggcctcacacggtagatctaatacaagttataaagagcgacttgaactagaatatttttatataagaaataaatctttattcttagatataaaatgtattctagcaacaattaaaggagttttatatagagaaggagcaaaataaaagagtgaataatctagtgaatatagaaatcatttgtccgctatataatgctgaaaattatattgaaacatttaataattctttacaaatgcaaaaaaacgtaaatatacaaaaaattcattatattctaactgaaagtaacgataatagcgagaattttttaattgacaataatttgttttatactaagatttctaaaaaggagttttctcacagtttagttcgtgagagagctgctatggcttcagactctgacgtggttgtctttgtaactcaggatgttgaaattgttaatgatgattggctttacaaattgacaagttgtcttaataatgaaatagttgcatcatattctagacagctgactaagtttgataatattgaaaaatatactcgtgaaaaaaactatccagaaatttctaggattgtctcagctcgtgatattgaagagctgggattgaatactttcttctttagtgatgccagttctgcaataagaacggatgtttttaaaatgctgaatggttatgatgggaaaaatttaccaacgaatgaagatatgtattttgcacataagttgattacgaatggatattctattaagtattgtgcagaatcagtagtgtatcattctcacgatttttctcttaaagaaatatatgatagatattggttaacgggtaagttttttaaggaaaatagttatcttaatgaatatgggacaaattctagtggtgcagagctagcaatatatatactgaaaagaatttttgaagagaaacgtttcggtttattgtttagatttccttttgatatggctgctagatttttgggaatgaaagcggggatgaggtagcagattatgagtacaatagattttgttgttatgtgggttgatggtaacgacccagagtggcaaaaggaaaaagctaaatatactgtagatagtaacgcagatggttcaatttatagatatagagattttggtttgctaaagtattggtttagggggattgaaaaatttgctccttgggttaataatattttttttgtaacttggggacatgttccagaatggcttgatttaagcaatcctaaactaaagattgtaaatcattccgactatattccagcagaatatctcccaacatttagtgctaatacaattgaaaataatttacacagaatagaaggtctatctgaaaattttgttttatttaatgatgatttttatcttataaattatgttgatgagactgatttttttaaaaacgggaagccaatggatacagttgctcttaatgttcagtgtccacaaaaaagtttagttagtagatattttggaatcaataatacagcaattattaatgatcaatttgattttaaaaaatcattgaaggaaaatttttggaaatggttctctttcaaaaatggaaaacctatgttaaggagtattattttgaaatcatgtccacgttttcctggtttttggcaacatcatctcgcaacttcattttgtaaatctacttttgaagaagtttggagcaatgaatatgaaactttgaaccaaacgtcgactcacagatttcgagaatcaactgatgtaaatcaatggttgtttaaagattggcaaattgcagctggaaatttcgaggttcgtagtattaagtttggtgaagctttttatattgatcgtgatggaattgcttcgattcaatcaaaaataactaattatattgtaaagcaaaaagggaaaatgatagcaataaacgacggagaaatgacagatactgaatttgaaaatctagtagcggatctcaccaattcttttaataaaattcttccagaaaagtcatcgtttgaaaagtaaataaggttattatgataagattagaaaaactacgattatatttttttgttttttcaatgtttttagttgagtttagtgctttttcacaaaatgttaactttgtttattcaattaaagatggtttggtaattctttctattttaataatgatttttaatttatttctaaccgctgttgaattaagagatataaaaaaatggggcattatcatattgttcttcatattatctctgattagttattttaaaactcaggatacattatttattcaacttagcttgatgttattctgttccataaatttaagttttgaaaaaattattaaaagtgatattgttttcaaagtttttatccttttatttaacttattatttcattttagtggattaactattacctcttattttgtgagacgtggcattgagcgtcaagcttttgggtttatacatcccaatttatttggtttttttgtttttatactaatatttgaaatagtacttttgtatgagatttcttctagaatgaaagcatcgctttttttacttattacgacacctgcttttatactattgaatatggctgcatctcgggccgcacagttatcattattactattttctatattattcttgttaaataagttattgaataggaagtctattatatttttgaattataaattttctggtctaatgatttttatactattaatttttggaacagttcaactaacgaatttatatcctcaaaattcaattgtggttactttaaacaatatcctaagtaatagattattatttcaaagtatttttttaaggaattataatttttccctatttggtaacattgttgactatagtagatatgtattagataattcttatttgagacttttattgaattatggaactataacttcatctatgtttgcttacatattttactcaagccttcgtaaagcaaagaataattatactatgcaattagtttttgtcactttgatgttttacggtttgatggaatggtacatgctacgtccatttctgaacattttcttagtttattttatgtgtgataataatattttaaaaggtagtttagatgatgaaaaaattagtttcaataataataccaatatacaacgctgaagattatattgaagattgtttaaattctattttaaaacaaggtatcaaagaaattgaggttctgctcattaacgatgggtcaacagataatagcgagagaatttgtcttcagtattgcaaaaagtttaatatttttagttatttttataaaactaatacaggcgtttcagatacgcgaaattttggtatttcgaaagcagttggaaaatttatttgttttatcgattctgatgatattctttcagacaattatttatctgatttcattatagcagcagaaataaatcctgattcagaactactttgttgtgattacatcaaattcgttgattttgaagatattaaaatgaataatgattgtagttctgttctaagaagtagtcagctagatcaaggagaaaaatatgatgttttatttaacaaatatggtggttatttatggaataaaatatttaaaaaagaattaattgagagaaatgaactaaaattttgtacagatctttacatgtgtgaagatatgatatttatttttgagtaccttcagcatattaatcaagtgaccctgattagtaaaaagaattattattatagacttcacaatgtttctagtggaaaaaataaagctaatcctaaatggttttctgtattggatgcttgtgaaaaattattgttaggtagggaatgctttaatacaaatcaagtcaaagattttgcttatttttacaactatatggtatgtaagagtaaatatagattgaggtatatttcccaggaaaaggaatcactgaaaggaaaagttagaaaatctcaaaacaatgcaaggactttaaggagttatttaactttatttcaaaaaataaaaatctatctttatggtactttttattttccaatttttttaattaagagagattaggaaatataggacacattatggtatttagaaaattatcaattataattcctgtctataattgtgaatcatttttagaaacatgtctcaattctattgtttcagaaatgaatgagttgattgaattgattttgataaatgatggttcaatagatggtagtggagaaatttgtgaaaaatattctaatcaatacgagaatattatctatctcttaaaaaataacactggagtttctgacacaagaaatgttgggattaattctgcgcaaggggagtatattatttttgtagattcagatgattttcttgctaaaggatggagtaaggtcgtcttctctctttttgaaaaagatgctgattttactattattgaaagtggtttaagtaaggaattatacactaagaaggaagtttttgattgcttatttcatttaaatcacaatataaaatggtgctctactccttggtcaaaaatttataaaagaagtcttttgttggaaaaaaagatcctattcgaaacgaatgtatttcatggtgaggatcttttgtttaatgctgaggtaataagtaattcaactaacatcttattttccaacaagaacatttattattatagacagaataatttatcaataacaaagagtttcaacaagaatatttttgaatctgataaaaaattccttaacattgttaaacaaaaatatgatataaagtattattatttttgtttagaaaacgcaattatgatgttcttgaataaaatttcccaagttaactatatggaaggatttaagttttatagaatattcagggaagaaccttactcaagttatattcgaaataacagtgattattttaataaatcacgtaacatacttttcaattttattaaatacgatttaatatttatcttaataattgcttttaaagccaagaatattattgctcgaaataaaattgatagtttaattaaaatataggagaaattaatatgaaaaaagttgggattataacatttcataattcgtataattgtggttcaatgcttgagacctatgccatgcaaacaattttggaaaagcatggtctaaactcagaaatagtaaacttttctagtgatggtcaaaaagagctgtattcaatttattttaaaaaaaacacactgaaaaatattgttaaaaactcattattgttcttacaaagaaataggttgaagaacaataatgcacagtatgaagcattcaagcaaaaaaattttaaactctcaaaaacatataattctggtgattttattgatgaaactccctattctgttgtagtagcaggtagtgatcaaatttggaatgtaactatcaaagatgctgatgatgcctatttcttgaactgggtagaagtagctagaaaagttgcctatgcaccaagttttggagcaaagaaaatttctgattatgcaccagatgttcagttatacagaaattttttaaatgattttgatgctctatcaattcgtgagaataatggacagaagtgggtaaaagagttaattaataaagatgttgatgttttgttagatccgacacttttacttgagaaagaagattatgatttaatcgcagcggatgatgttaaagttgatgaagattatattttcttttacagtccatcttttgatacagaaatttgtgattatgttcgtaaaattgctgataaacataacttgaaagttattacatggagtacaaaatcatatactaccaaatttgttaaaaagtatggatttgaacttcctagttatgaaaatccagcagcttacttaacattgataaaaaatgcaaaactgattatcacaacatcttatcatggaacaattttctctacaatttatagaaaaaactttattacagtaaaaaatggtgaaatgtatggtgatgacgatagggtaataactttacttaatcaactaggaatgatggataggttgatacctttcaattttgaccctaatttcaattatttatctgatgtagattattctcaatatgatgtaaaattaaatccacaaaagattaaatctattgagtatataaaagagaatatagtggattactataaagatggaatcaattaaaaaaaatttaatttacaatattatttatcaaatcttaataattattttacctttaataacagcaccatatatttcaagagcattaggtcctactgcacttgggatttactcatatacttattcgatcgctaattattttttgttagttgcaatgcttggtatctcaacttatggaaatcgacaaattgcgtcaactagagataatacgagaaaaatgagtaaaactttttttgaaatttattctgtccagtttacgacattctcgattgcaattattatttttttatcttacattgtattttttgccaaagataacaagataattctctttatacaagttttatatattttatcgggattacttgatataagctggctattttttggattagaaaaatttaaagttactgtaagtcggaacttgattctcaaattattgacggtttttgcggtctttgtttttgttaataatccagaagatttatggaagtatgctttgataatgtcagctggaacacttataagtcaaagctacttgtggttctatattaaaggaattgttaagtttgaaaaagtgtatatggtggatatattaggtcacatcaaacctatactgatcctctttatacctgttatttcttatagtatttataaagttatggacaaaattatgctcggatctttaacatcatatgatcaagttgggtattatcagaatagtgaaaaaataattagtataccaatgggtgtaattactgccttgggaactgttatgttaccgagaatgtcaaatattgtttctaaaggtgataaatctaaagagaaaagttatatttctctctcaatcaaactagtaacaattattggtgtagcaattggttttggtatcataggtaccagtgacattcttgcaattgtattttttggtaaagattacagtgcttctggatcaattatgtccttgttatccctaacaatactatctatctcatgggcaaatgttatgagaacgcaatatctaataccaaataattttgatagggtctatgtgtcttcgtctatgcttggtgctgttataaattttattgttaacattactttaatacctgtatttcaagccaatggagctgcaattggaacaatttttgcagaaacctcagttatgttagtacaattgattttttgcaccaaatatattccaatctcaaaatatatttttcaaactattccattcattgtaaatggcttgattatgatggtagtggttaatcttgtaggcaactatttgggaatctctttatttactttaattgtgcaaatcattattggtggcttgttatatgttagtttaactgtattttacttatacattgttaaagatgacttattatacttactacttaaacaagtaaaactctaactcaggttccacctgctaacccatgacagaaaaagatgttcggcttataatgaagatgaacaatacaaatccgagatttttaatagggctttgcctagcctgtaagtaaaactggatgaataagagtcatgagataactcgaatacgcagagaagcgtgaaaataaaagtaagcgtccaataacaaggtatctgtaaaacaagtaattcttcccttatactgttagtagaaaacagaaagggaggatttttttatgcctcaatctattgtccccttgggaacgccacaatcccgtcgttttgaaaagaagagtcaaaatgacttgctactgaaaatcagactgggtaaatttgaagttagtttctttcaggctttaacacctgaacaactagactctcttttagaaaagatacttgcttatgactataaaactaaatgatttaggtcaggtctatctggtttgtggaaaaaccgatatgagacagggtattgattcacttgcttaccttgtcaaaagacaatttgacttagaccccttctcaagtcttcctcttttgtggtgggcgtaaagatcgctttaaggcactctactgggatggtcaaggtttctggctgctctataagcgattcgagaatggcaaactgacttggccaaacactgaaaacgaggttaaggccctaacctctgaacaagtggactggctcatgaagggattcgccatctctccaaaaataaatgtttctaaaagtcgtgatttctattgaaatcatggtaagcgtccaataacaaggtatctgtaaaagaggtgattcttcccttatactgttagtagaaaacagaaagggaggatttttctatgcctcaatctattgttcctttggaaatatctcaatctcgtcgatttgaaaagaagcgtcaaaatggcctgctactgaaaatcagactgggtaaatttgaagttagtttctttcaggctttaacacctgaacaactagactctcttttagaaaagatacttgcttatgactataaaactcaatgatttaggtcaggtctatctggtttgtgggaaaactgatatgagacagggtattgattcacttgcttaccttgtcaaaagacaatttgacttagaccccttctcaggtcaagtcttcctcttttgtggagggcgtaaagatcgctttaaggcactctactgggatggtcaaggtttctggctgctctataagcgctttgaaaatggcaaactgacttggccaaacactgaaaacgaggttaaggccctaacttctgaacaagtggactggctcatgaagggattcaccatctctccaaaaataaatgtttctaaaagtcgtgatttctattgaaatcatggctctcttttgttttaataacagtatagaaatcaaaggagatgagagatggaagagctacttgccataatcaaacaacaagccactacaattgatgtcatgactaatgagttagctctcttacgcgaacaagtagcttatctcactcaaaaactctacggaaaatcatcggagaaactacctcaaatgagtgggcaattaagtttgtttgaggaggatggtctcccggaagaagaatctgacttacccagctgaaactgaagtcattacttacaaacgcaagaaggttaaagggaaacgtctggcagatttagaccagcttcctcaagtcgaccagcatcatgaactgtcagaagaagactgtgtttgccaggactgctcctcacccctaaaggagattggtagtcagtgtattcgtcgagaggttgtctttattccggcaactttggagtgtgttaatcatatccagcacagttataaatgtctcacctgcagtcaaaagagtcctgtagacaaaatcattaaagctgatttacctaagccagctcttaatcatagtctaggttcaagctcagtgattgcccatgttatttatcaaaaactggaacagaaagtcccgacttaccgtcaagaatccttttggcaaaatctgggcttaagtgtgactcgtagagaattaagtaactggctaattctgtccaatgcttattattttgcccctttatccgacctccttttggactatcttcgtaaggagcctattttgcatgcggacgagacaagttacaatgttcttgagagttcccaaagcacaaactacatctggaccgtggccagcagtaagcatagccagacaccaattatctattatcgctatgatgatagccgttctggtcaggttatccgtgatatcctaggtgattttcagggctacttgcaagcagatattcgatacccatcaaaaaatcctcgaggcataagtttcgaggattttctagataccttgttattggacgcttacttttaaagttcctgtaaccaaaagtatttcgtttaatgtctttgatgagtttgtttgttgcttctaacttggcgttagagtaagtaagttcaatggcattggtaatgtatttttttagcgaataaaggtgttcagtacggttttaaaagtgtgattgagatgaggtaaggtatgctgaattaaaccaaagaattgttcagtattcttctcttgtaagtggaaaagaagtagctggtaaaggtcatagtagtctttgagttgaggtaccaatttgaatatttttttaagtaccctttcacctaatatattcaactaatgacagcaaattttaaaaatgataaaatgatgataaagaaatttttaaggagaatcacatatgaaaggtattattctagcaggaggttcaggaacgcgtctctatcccttgactcgcgccgcttccaaacagctcatgcccatctatgacaaacctatgatctattatcccctatcaactctcatgttggctgggattaaagaaattttgattatttcaacgcctcaggatctccctcgctttaaggatttgcttggcgatggttctgagcttggcatttctttgtcatatgcagagcaaccaagtccagatggattggctcaagcctttattatcggtgaagacttcattggtgatgaccatgttgcccttattcttggtgacaatatctatcacggtgctggaatgactaaaatgttgcaacgtgcagcagctaaagaaaagggtgccactgtctttggttatcaggttaaagacccagaacgctttggtgtggttgaatttgatgaggacatgaatgccatttctatcgaagaaaaaccagaagtgcctaaatcaaacttcgcagttactggtctttatttctatgataatgatgtggttaacattgccaaaaatatcaaaccatctcctcgtggtgaattggaaatcaccgacgttaacaaagcttatcttgatcgaggagacttgtctgttgaacttatggggcgtggctttgcctggttggatacgggaacacatgaaagtctcttggaagcctctcaatacattgaaaccgttcaacgtctacaaaatgttcaaatcgctaacttggaagaaattgcctatcgtatgggttatatcaccaaagaacaagtctttgaattggcacagccacttaagaaaaatgaatacggacaatacttgctccgtttgattggagaagcttaatgactcaagaattttttgataaagaactggcagctcgccaaatcgaggctatcccaggtctcttagagtttgacattccagttcacggcgataaccgtggctggtttaaagaaaacttccagaaagaaaagatggtgccactcggttttcctgaaagcttctttgcggaaggcaaacttcaaaacaatgtttccttctcacgtaagaatgtccttcgcggtctccacgctgaaccttgggacaaatacatctcagtagccgacgaaggcaaagttcttggttcctgggttgaccttcgtgaaggggaaagctttggtcacgtctaccaaaccgttattgacgcttctaaaggcatctttgtgccacgtggtgttgccaatggttttcaagtcttgtccgataaagtagcctacagctaccttgttaacgactactgggcgcttgaactcaagccaaaatatgccttcgtcaactatgcagacccaagcctaggcattgaatgggaaaatctagctgaagcagaagtgtcagaagctgataaaaaccacccaatgctcaaagatgtgaaacctttgaagaaggaagatttgtaaagatccgtaaaaaatatctaaactacaaaaaatcagcttcttaaaacccaacattaagattttaaaaggcgagtgaagcgagcctaagagggatgtttgacgcagtggtgaaaagatatcttgcaagattgctagatatctcggaaattttgagactcttagctcaaaatttaggcatggaattccgatggaagtcgctgccgtccgcaccaccttagttgaacaacaaaaaccaaagaaatttcggagaaaaagaaaacatgtctgaatttaaaaacattatcgtaaccggtggcgctggtttcatcggttcaaacttcgtacattacgtttataataatcacccagacgttcatgtgaccgttcttgataaactcacatacgctggtaaccgtgctaacttggaagaaatccttggtgaccgtgttgagttggttgttggtgatattgcggatgccgaattggttgacaaattggctaccaaagcggatgcaatcgttcactatgctgctgaaagtcacaatgacaattccctcaatgacccaagcccattcattcacaccaactttatcggaacttacactttacttgaagcggcgcgtaaatacgacatccgtttccaccatgtgtcaacggacgaagtttatggtgatcttccattacgtgaagatttgccaggacacggtgaaggaccaggtgagaaattcactgcagaaactaaatacaacccatcatcaccttactcatcaactaaagctgcttcagacctgattgttaaggcttgggtgcgttcctttggtgtcaaagcaaccatttcaaactgttctaataactacggtccataccaacacatcgaaaaattcatcccacgtcaaatcaccaatattttgtcaggtatcaagccaaaactctatggtgaaggaaagaacgttcgtgactggattcacaccaatgaccattcaactggtgtttgggcaatcctgaccaagggtcgtattggagaaacttaccttatcggtgctgatggtgaaaagaacaacaaagaagtgcttgagttgattcttgaaaaaatgggtcaacctaaagacgcttacgaccatgtgacagaccgtgcaggacacgatttgcgctatgcgattgattcaaccaaactgcgtgaagaattaggctgggagccacaattcactaattttgaagagggccttcaagaaaccatcaactggtacacagaacaccaagactggtggaaggctgaaaaagaagctgttgaagctaactatgctaaaactcaggaagttttgaaatagaaaagagctccacgtgagctttttataaaataactaaaagaagtgacgagaggagtcagataatgattttagtaacaggtgcaaatggtcagcttggaacagagctccgttatttacttgatgagcgcaatgaagactatgtggctgtcgatgtcgcagagatggatattactgatgcagataaggtggaagaggtattctctcaagtcaaaccgaccttggtttaccactgtgcagcctacactgcagttgatgcagctgaagatgaaggaaaagaactcaactatgccatcaatgtgacaggtacggaaaatgtcgctaaagctgctgccaaatacggtgcaaccctggtttatatttcaacagattacgtttttgatggtgaaaaaccagttggacaagagtggttggagacagatacaccagatcccaaaacagaatacggtcgtaccaaacgtttaggtgaagaagcggttgaaaaatatgcggacaaattctatattatccgtaccgcttgggtatttggtaattatggtaaaaactttgtctttaccatgcaaaatcttgccaagacccatgatacgctaacagttgtcaatgatcagcacggtcgtccaacttggacacgcacattagcagaatttatgacttacttagccgaaaaccaaaaagcttttggttactatcatttgtcaaatgatgccaaagaagacacaacctggtacgattttgcagttgagattctcaaagatagtgatgttgtcgttaaaccagttgattcaagctcattcccagctaaggccaaacgcccattaaactcaacgatgagtctggctaaaacaaaggcaacaggttttgttatcccaacttggcaggaggccttgcaagagttctataaacaaggtaaaaaataagttgagagtgagactagtccggctactcaatctaaagttaatgcttgtagagtaatgtgacaaaaggagttatttatgaaaaaagttagaaaagctgttattccagcagcaggtttaggaacgcgttttttaccagcgaccaaggctttggcgaaggaaatgttaccgattgttgataagccaacaattcaatttattgttgaagaggctttgaagtctggtatcgaagacattcttgttgtgactgggaagtcgaagcgttctatcgaagatcattttgattcaaactttgagttggaatataacttgaaggaaaaagggaaaacggatctcttgaaacttgtggatgagacaacaggtattcgtttgcactttattcgtcagtctcatccgcgtgggctgggagatgctgtcttacaggcgaaggcttttgttggaaatgaaccttttgtggttatgcttggtgatgaccttatggatatcacagatgagaaagctctgccattgaccaaacaactgatgaacgattatgagcagacatttgcttctacaattgcagtaatgccagtgcctcatgatgaagtgtctgcttatggtgtcattgctcctcaaggtgaaggagtcgatgggctgtatagcgttgatacttttgtggaaaagccagcgccagaagaggctccaagtgatcttgctattatcggtcgttatctgttgactccagaaattttcgatattttggaaactcaagagccaggggcaggtaatgagattcaactaacagatgctattgatacacttaacaaaacacaacgtgtttttgcaagagagttcaaaggaaaccgatatgatgttggggataaatttggatttatgaagacttccattgattatgcccttcaacatcctcaggtaaaagatgatttaaaacaatatatcattgaacttggtaaaaaactagataagtaaaaataaattggtctgattgagagtcagccagtaatctcagaggttgtagtttggaaaagaatgatttctttgctgctagccaggaattaactatttactctctgggagattataaaatagaggaagctggaattatccaatgtcattaagttaagcatttaagcagctaaagaaactattcccgtttgagcgattcatgacaaaatggggatagttttatatttagggcgcacaaaaggaaggtgcttttgccctatttttcaactattatgttactctataagtgaagcttacaggtagctggcttcgtatttttcttcggaatgttcgattgggtcgaataatagataggtgcttggcaacgtaggtttccaattggaaggaagagagtttgtttctaagaaattttcgacaggcataaacagcgtctgaaaaacaaattttataagcctgtttgaactttaatagtttaatggtaacgtgtgaggttagccatttacaaacattaaaattgataaagcgagcgtagatttcttggagaattccttccttctttttcgcatgaaaatgagtcaacccaatactatattttaggtcacgaaaactggtttctatgccccatctgtaggcatagagatcttttaatttttctggtgagtaatccgtatttgtcaccaaagtctcaaagaaacctggcttgatttcgagacgcaccattcggaaatgaagttcataaaactggagtggatcactttttcggctagagtttggtaaaaggtcaaaggaagcattatgaggtaaaaaatgatactgattagggaagtctcgatacagttctttcatgtcattggtttgtttgcgacagatgtttaggtcaaatgcctcatcaaaacaaggggtgtcagggagatgaaaactcgttttcatagaattatttccatcgcgaatacgaataatataggaccaatttctttcttggcagtgagccatgacattgtaggattcataccccctatccattatcaccagagcttgttcaaaagggacaactctccatcatatcaataaaagccgcacgctcatcaacctcttgattatcttgaatccgtaaatcgtgataaatctcctgttcaagattgtagagagcattgatatgaatgagattatagggagtgtgatgtggtccagtttgaaaagaggtcgttttatcagaacgatttcttggtagaatcacatcactaccatcaacagccaggatagggagattatcagagattggaattttagaagtaatatccctaaaaagtgttttaaaagcttggtgtttaatctgataccgtcgttgaacaaaggcagattgagagacaggcaaatctaaatcaagtagctctttggctaaggtattaccacccatggtcagtatagcttgaatcatggttttcatcgttagctgacttttccgactaaaatctttttcaggatgaagcacaaactggtttgcggtggaaacgatgtcattaatactatcaagtaaatgagctttaatatgatctaacatgacttttcccctttatttttagtgtaccatagaaaaaactaacctaccacaaaacgtgataggttagttaacttaatgacattgtggaattatccagcttttttgatgatatgtgaagctatgttataatgaatatatgacaagatcgaaatttccattgtggtcaattagaaagaatgatttatgacgatagatattgaaaagtaccatgatttggcacaacaaaagcaaggagagcaccgtaaatttttggtatctctgaagaaaaaggctcccaaaaatctagatcagattgtccagcaagtccatggagaagtttttagggagatagattgcactcagtgtgccaactgttgtaaatgcttaggtcctctgtttaccgaggcagatattacccgcattgctaagcatttccgcatgaaattacctgtgtttgaagaactttacttacatgttgatgaagatggtgataaggtttttcaatccatgccttgtccttttttaggggatgataacctttgttcaatctatgacgtacgaccaaaggcgtgtcgagaatttcctcacacagatcgcaagaaaatctatcaaattaatcacttgactatcaagaatactttgacctgtccagcagcttatctttttgtggaaaagcttaaagagagaatttgaggcaagtagtaaggagaagtggggatcaaatagaggaaacatttttaaaatagcctctgcttggttagttatctgaatgtttcattggtaaatcttactcatcaaggagaactgacaaaaacagagtgatttttgaagagtatgatactagtacagctaggcattaggatacagtgtcatgtgagtaggtaatataaaaaggagccatcagcgatgtgctccttttcgcttggtctatttaaccaagttttgtaatgtttgttgcttgaaggccacgttgaccttgttcaacatcaaatgctactttttcaccctcgtttaaggatttaaaaccatcgctttggatagctgaaaagtgtgcaaagacatcaggaccattttcctgagaaataaagccaaaccctttttctgcgttaaaccattttactgtaccttgtgacatctgtatatacctctaaatatttatttgtaaaaattattaagaggaaaacaaaagatgaaactgatactttaactctaaatcattat

SEQ ID NO: 66 - DNA, 24182 bp, Streptococcus suis
ttcatagagtataaaaaagtaagactagaaatgagaaaattatgccaaaatggaaaattgttgtagattcgggctgcgactatcgtcaactgaatcacttagctcctgacactgaattcatcagcgtaccattgacgattcaaataggggaacaagccttcgtggacgatgcaaatttggatattgaccgaatgatggaagttatggaatcttcatcctctgcagcaggttcggcctgtccaagcccacaagcttatcaggcagctttcgagggtgcggaaaatattatcgttgtaacgattacaggtggtttgtcaggtagtttcaatgcggctcgtgtggcacgtgacatgtatgttgaagaacacccagaagctaatattcacttgattgatagcctttctgctggtggagagatggatttactggttgatgaaatcaatcgcatgattgggacaggaatggattttcatcaagtagtagaggctatcactcactatagggaacgcagcaaacttctttttgtcttagctaaggtggacaatctcgtaaaaaatggtcgtctcagcaagattgtcggtgctgtcgtggggcttctcaatatccgtatggttggagaagctagcagtgagggaacactggaattgcttcaaaaagcgcgtgggcataaaaaatctgtcatagcagcctttgaggaaatgaaaaaagctggttataggggtggtcgcattgtaatggctcatcgtaataatgctaaattcttccaacagttttcagagttggtaaaagctacttttccaacagccattattgatgaagttgcaacttcaggattgtgtagtttctatgcagaagatggtggactcttgatgggatatgaagttgaataagtcttgaaaaagtatataaaaagcgccttgttggaggcgtttttgtattcaaaatagggaaatcttcccttaaatatcttttttcattcccagtttgttcaacaatagaatcaatcgagatgaaaagtctgtgttatagtgcatttgtaaaaaatcgtattctcgtccagaaaaataactcatacctgctagctgatgttgaattgcaggtatgatacttcccttatcaagttggaaagttacgcttttctttgagaggcaataaggaatgttcacggagtatttttctaaacaagctttcatatcagccagttgggaatgatgtatttgttgaagatgtcgtgtattacgagaaaacataccgttatcaatatagagggaaagtgctttttgcataatcaggtttgtgtcatagtcaatcaatcttttatgcttgataaagatattatgcagttgcttcggtagactaacagcaccgattcgcagggcaggaaagagagtaggagtaaaggacttgatatagataactcgattgttggtatccaaataatgcagaggaagactacgattggaatcgaaatctgctaaatagtcatcttcaattacatagacatcgtacttttcagctagctctaaaatagctgtttttgttgccgtattgtaagtagagccaagcggattatgtaaacgaggaatggtatagaagaattgaattcttccagtttggaagatttcttccaatcgcttcaagtcaattccatctaaatctcgctcaatagtctgatagggaatcccctgatgttgaatgagttctaccatccgagaataagtagggttttccagtaaaatatctgttttatcggaacaaatatccatctgtgttagaatatatagagcctgttggctaccagctgttatgactagctggtctttttgagtatagacatgataatccattaaaagactttgaacagaggaaatcaactcagccaagccttcttgttgatggtagtaattaaacaggtaattttcccgaccgattaggctttcgtgtaggcaaactcgaaaatcttcgtagggtaattcctgaaaagcttcaggatttagctccacggcataatcttgaaactggcgatcttctacgatatagtagccacttttttcaacagcataaatcttatttttatactttaactctagcatggccttctgcacggtatctttactacattgatagtgcttacttaggctacgaatagaaggaagcttttctccacgcctaaaacgatgttgttcaattccagatagaatatcttggacgatagcttggtatttgttcattttagactgtccccctacagattgtattgttagcagtatacaaaaaatgtaataaaaaaacaacatcggacgcgtgattttggggtaggaatcagattttttatgatataattagaaaatgaaactgattattccaaatgctaaagagttgaatacaaatctggacaattttccttttcaggatttatctgaaaaaagtgagcctatcttagaagtgattggtaagtttagtttggaagaactatcagccttctacaaattgcccaaatcaagagctcagctagaatttgatcgttggcagagaattcaatcaaggcaggccaaatcctaccctgcctggcaactatatgatggtctcatgtatcgctacatggatcggagagatgtgacggaagaggaaatatcctaccttaaaacgcatgtccgcttagcaactgctttgtatggtttgattaacccatttgaactgatttctcctcatcgtctggattttcaaggcagtctaaaaattggtcagcagtctttgaagcaatattggcgctcatactatgatcaagaagtagctgatgatgatgtcatcctttctttagcctcatcagaatttgaacaagtattctccccacgaactcgagagagattgattaaagtcattttcatggaggaaagagtaggagagttgaagatccattcgattatttctaaaaaaggacgaggaagaatgttgtcatggttggctaaaaacaatattcaggctctatcagatttacgaactttccagctagatggattccactattgttcaaagaggtcgacagagaaccaattcgtctttattcgtccggcagataatgtgaaatattgaacaagataacgttttcccaagctacgcttagctagataaatctccttttctatgatataattgacgagttataagcaaaaggaaggttttttatgaaaaacagaagaggtcgaaggaaatcatccaagctcaaactggtgaatctggttctttgggggctctatgtgattaccttatgcttgtttttgacgaccatgcatcactataatatattagattttcgatatctgaactacgttgttacagtgattttggtagggatagcgatgttgacagcatggctgatgtggcgtagaaaggcacgtatgtttacagtgtcgcttcttatcctatccctccttgtaacttcaattggaacttacggaatgcaagaggtcgtagcattctcaaaccgaatccaatcaaattctgcattttcggaatatgagatgagtgttcttgtcccaacgactagtgaggttacagatgtccatcagcttaatcgtttacttgctcctgctggttatgatcaagaaaatgtatcctctctgttgagtgatatctctaaaatggaatcagttcagctaacaacaagcccaactagctcttatctcaccgcttatcgagcgatgatgaatggtgaggcgcaagcgatggttttaaatggagcctttacaaatatcctagaaagtgaagatccagaattttcttcaaaggtgaagaaaatttatagttttaaaataaccaaggcagttaaaagggcgactgagcaagttaagggagatagttttagtatttatatcagtggtattgatacttatggtcccatctcgtctgtttcgcgttcggatgtgaacattatcatgacggttaatcgtaaaacgaaaaagattttgttaacgacaacgccacgagattcctatgtggccatcgcagatggcggccaaggacagtatgataagttgactcatgccggactctatggtgttcaagcctctgttcatactctagaaaatctctatggtataactattagtaactacatccgtctcaatttcacctccttccttcagctgattgacctggttggtggagttgaagtagaaaatactcaggaattcaccaggggagggtatcatttcccaattggaacagtgcgcttaggtgctgaacaggcattgatttttgttcgggagcgttattcgcttgttaatggtgataatgatcgagggcaaaaccaagaaaaggttattgctgcccttattaaaaaactaggttctcctgagaatctacgtaattatcaagcaattttgtcagggttggaaggttctatccaaacggatatgagccctgaaactatcataggtcttatcaatacccagttagaatctggaacacaatttatggttgaatcgcaagcgttaacggggactggtcgttcagacttgccgtcttatgccatgccgggctcgcagctttatatggtggacattaaccaagatagccttgaacgagtaaaaacagcaatccagtctgtattagagggaaaataatgaataacttaggagaaactatgaataaacaagaaatgaacacaattgaaatcgatgttttattcttactaaagacaatttggagaaagaaattttttattttgttgacagcccttttcggagcaggtctagctttcgtttatagtagctttttggtaactccgcagtacgactcaacaactcgtatttatgtagttaacaaaaacgttgaagcaggggctggtttaaccaaccaagctcttcaagctggttcttacctagtaaaggactataaagaaatcatcctatctcaggatgtattgactcgagtaaaatcagagttaaacttaaagggaagcttgaaatcaaaggtttctgtatcaattccggtggatacccgtatcgtttctatttctgtacgcgatgccaatccaaatgaagcagctcgtattgcaaatagccttcgtacgtttgctgcgcagaaaattattgaagttacaaaagtaaatgatgttacaacacttgaagaagctgttccagcggattatccaataactccaaatacgagacgaaatgttctcataggactattggcaggtggtatgcttgcgatgactcttgttttggtcatggaagtgttggacgatcgtgtgaaacgcccacaagatattgaggaagtaatgggactacctcttcttggtgtagttccagattcgaagaaattgaagtaggaggaaaatatggcaacactagaaattgcacgtacgaagcaagaacttgttcacaaaacggaagaatattttaatgctatccgtaccaatatccaactgagtggagaagacatcaaagtggttggaattacctctgtccaatcgaatgaaggaaagagtacaacggcggcgagccttgcgatagcctatgctcgttcaggttataagacgatactcgttgacggtgacattagaaactctgtgatgtccggctttttcaagccgttaacaaagattactggcttgacggattatctttcagggacgacagacttatcgcaaggtctatgcgatacaaatattccaaacttgaccgtcattgagtctgggaaagtttctcctaatccaactgctttgctacaaagtaagaactttgaaaatttactagcaactcttcgtcgctattatgattacgtgattgttgactgtccgccgctagggatggtgattgacgctgccatcattgcacagagatgtgatgcgatggtccttgttgcagaagcgcgacaggtcaaacgttcagccttgaaaaaagttagggaacagttggaacaaacaggcactcctttcctaggtgtcatcttgaataagtacgatgttgcttccgaaaaatatggtgactatggaaattatggaaactacgggaattatggaaagaaagcctgattttctctatttttagagttggataagtaggtggtaaggtatgattgatgttcattcgcatattatttttggtgtggatgatggccccaaaacacttgaagaaagtgtcaatctaataggggaagcacaccgtcagggagttcgtctcatcgttgcaacctcacacagacgaaaagggatgttcgagactcccgagaaaatcatcatggaaaattttatccatgtaaaaaaggctataaaagtagcttatccagatatggttctttgctatggaggagaactttattatagtaaagatattttggataaacttgagaaaaaaagggttccgacactcaacgggacgaggtatattcttttagagtttagtatgaataccccatggaaggaaatccaagaagcagtaaatgaagtgatactacttggactgactccgcttgtcgctcatatcgaacgctataacgctcttgccttccaggcagaacgtgtagaagagttaattgacaaaggctgttatactcaggttaatagcaatcatgtcttgaaaccaggcctaattggagatcgtgcaaaagaatttaaaaagcgtgttcagtattttttagagcaagatttggtacactgtgtcgcaagcgatatgcataatctgacagcgagacctccctttatgaaggaagcctatatattaatcagagaggaattcggtgaagaaaaagccaaattgttatttaagaaaaatcctctactgttattgaaaaatcaggttatttagaacttatctagaacttggagagaaaaatgaaattgggtactattactgataggcttttagagcgcaatagtaagagattgatattgatattcatggatagttgcctgattataacttccatgattttaagtagactgtttttagatattatcattgatatcccagatgaacgatttattctagctgttgcatttgtattgttttgttattttgttatttcggttaaattaaaggttttctcagtaatcacacggtatactggataccagagttttgtcaaaataggaattagtttaatttcagcttactcacttctgttagtaatatcaaccattcaatggcaaacttttagctatcgcttcatgatggtttccttattcttatcctttgtcttgcttattactcctcgcttgctttggaaggcacttcatgagggtagaaaaagtgcaatccgtaagagaagcggttctttgcgaattttagtggttggtgctggcgatggtggaaatatttttattaacactgtcaaagaaagaaaattgaactttgaaattgtgggtattgtggatcgagatccaaataaattaggtacctttattcgtaatgtagaagtactgggaaaccgtaatgatattcctcgcttggttgaggaactagctgttgaccaagtgaccattgcgattccatctttaagcggcaaagagcgtgaaaaaattgttgaaatctgtaacattgcaggagtagctattaacaacatgccacatattgaagatatattgtctggcaatatgtctgctagttcctttcaagaaattgatgtggcagatttactagggcgtccggaagttatgttgaaccaagatgagttaaaacagcactttgaggggagaacaatcttagtaacaggagcgggtggttctatcggttcagagctttgtcgccagattaccaagtttactcctaggcgtctactcttattgggacatggagaaaactcaatttacctaattcatcgagagttgctgactaaatatcaggataaaattgaaataattccacttattgcagacattcaagatcgtgaattgatgtttagcattatggccgattataaacctgattttgtctatcatgcagcagcccacaagcatgttccactaatggagtataatcctcacgaagcagtgaaaaataatatttttggaactaagaatgttgctgaggctgccaaagccgcgaaggttgaaaaatttatcatggtttcaactgataaggcagtgaatccaccgaatgtaatgggagcaacaaaacgggtggcagaaatgattgttactggtttaaatgagccaaacaaaactcaatttgcagctgtgcgttttggaaatgttctaggaagtcgtggtagtgtcgttccattgttcaaagaacaaatcaaaaaaggtggacctgttacagtgactgactttcgaatgacgcgttatttcatgactattccggaggcgagtcgcttggttgttcaggcgggacatttggccaaaggtggcgagatttttgttttggatatgggtgagcctgtgcagattctggaattagcaagaaaagttatcttgttgagtggtcacactgaggaagagattggtattattgaatccggtatccgtccgggtgaaaaattatacgaagagttgctatcaacagaagaacgtgttagtgagcaaatccatgataagattttcgttggacgtgtaaccaataagaatacagctgttgtacatgcgtttattagtggcttgttatcaagagataagaacgaactgaaagatgcattgattggatttgcaaaacaggaatgaagaaagtaaaaaatattttactttcctagagtttaaacatatgtttaaattctaggaaggctgaaatgttattgagggattgaaagatgcttggtcaactattactggaagaaaaagaaatggggatgaaaggtggcctctatcataaagtacaaatagagttggcttttaattcaaatcatatagaaggtagtcagctttctcatgaccagacacggtacatttttgaaaccaacactattggtttcgaagatagttcatcaataaaagttgatgatatcatagaaactagcaatcattttacagctgtagattttttgttggatagttttcaggttgagttgacgacggattggataaagcacattcatgccatcttgaaacgtggaacgtctgattctagaaaatcttggtttcgagtaggaaattataaaatactccctaatgaagttggtggtagagaaacaacactaccggaaaatgtagatgctgagatggaaaaactgattgaaaattatgttaaacttagtcaagttaggtttgaagatgtattgaattttcatgttcagttcgaacggatacatccttttcaagatgggaacggtcgtgtgggacgtctgattatgtttaaggagtgtctcaagcatcaacatgttccatttatcattgatgatgatatgaaatatttttattatcgtggactttcagaatggggagaacagaatggctttttactggatacttgtctagcagcgcaggataagtttaaggcctatttagaatattttaggattgaatattaaagaagaggaaaaaatgtatccaattattaaacgttttctcgctgtgattatctcagggagtgccattattttttttagtccagtattgttaataattgctattgcaattaagttagactcgaaaggtccagtgttattcaaacaaaaacgtgtgggcaaaaataagaaatattttatgatttataaatttcgctcaatgtatgtggatgcccccagcgatatgccaactcacttgttaaaaaatccaaaggctatgattaccaaggttggaggcttcctcagaaaaacaagtttggatgaacttccgcaacttttcaatattttcaagggcgagatggccatagtaggtccgcgaccggctttatggaatcagtatgatttgattgaagagcgcgataagtatggagccaatgatattcgcccaggtttgaccggttgggctcagattaacggtcgtgatgagttagaaattgatgaaaaatcaagactagatggctattatgtacaaaatatgagttttgtccttgatttaaagtgtttctttggaactttccttacggttgtcaaaagtgagggggttattgaaggcggaactggacagaaaggtagcaaatgaagttttcagtattgatgtctgtatatgagaaagaagatccagaatatctgagattatctttagaaagtatccttgtacatcagacagtaattccaacagaagttatattggttgaagacggacctcttaatgatggtctatattctgtcttagaagaatttaaagctcaatttgttttttttaaaacaatacctctggaaaaaaatgtagggttaggtattgcactaaatgaaggcctcaaacactgtagtcatgaatgggtggcgcgtatggactctgatgatatagctgttagagatcggtttgagattcaattgaaatatctaaaagaccaccccatggtagacctcttagggggaggtattctcgaatttggaaagacaattgaagaggttgtatcaaagaaggtcttgccgactacgattgaggagattagagtttatagtaagaaaagaaatcctttttgtcatatgacagttatgtttaagaaatcagctgtttgggatgctggaggatatctgcatctgccatatgttgaagattattacctttgggtgagaatgcttgctttgaaaaaaaacgtagcaaatgttccaaatattcttgtatatgctcgtgtgggaaacggtatgactgaacgcagagggaatagggcacaaattaacagttggaagatcttaaatgagtttatgttaaaacacaaattgattacaccactagaaatgtttatcaatcagatttatataagagtttttgtttctctaccaccagatttaaaaaagctcatttatggaaaattattaaggaagtagtatgataacagtattgatggctacttataatggtagttcctttatagtgaaacaactggaatctattcggaagcagacggtaagagctaatagagtaattatcttggatgattgttcaacagacaatacgtttgagatcgtaaataaatttattgaacagtattctttaactaattggacaaactgtagaaatacctttaataagggacattatcaaacgtttatagaattgacgactatggtggaagaaggttatgtttttttttccgatcaggatgatatttgggataataataaaattgaaataatgataaaagaactcattaaatcggatgtgtcaatggtattttgtaaatcaaggttcattaacgaatgtgatgaagttataagtaaaccagcaactacaggagagcaccattccttttcggtgaaacgattattgcaagcatggccctcaggttatcagactgcctttaaagcagaagtattaaagacaataataactaatagatatcataaacatccctattttcaatttcatgatgtattatttgggatgttgtctggcatctttggtaatgttattgaggtagacgaaatcctagatagtcacagacttcacttgaataatgttacattatcttctaaaagcgtatcatttcataatacattagaaaatcgcttggattattatattaaaatgtataagagatatgaatttgttaatcatgtatctcaaatgtttggagtagacgaggctgaaaaagtctctaaaagctatggcgagttatataagtcaaggattagctttatagaaaaacgtaatataaaatcaataagagaaatatatagactacgtcattattataatggttatcgtgcatttattagtgatatcatatacgcactaagattgaataatctatttagtaggttaataaggagataaggtgagaagtacatccaaaattgagtgggaattagcaatagaatcctcttatcaagatatgtataagaaaatagatgctgaacatttaaaaagattacaagcagcatatttagaaatgtttattcttttgaataggaaatgctctaaaattggactgaagcctcttatggttgctggaacactaattggttcacttagacataaggggtatattccttgggatgacgatattgacctagtattatccagacagaattacgagcaattaaagtcgcttttgaaagatgatgaagactttgtgctgatagatccaagtaataatacttctggtattcataaaatgttaaaaatccaaagcagatcattaagtttatttgatgttatgggagagggattcagtaaaagtaaatttctttatttggatatgcttccgattgattatgttcctgataacagcatcaaacgaaaaataattggaactatttttaaatgtttagattattcttattcgagttgcagatgttttaaaaagtattccccgcatttgaattatatggctaatggctcaaatgaactacgaaaaaatcttttcattcgtaagtgcataggctttccagcatatttacttgggcctcatagagtattcaaactaatggaaaaattattgatgtctgtttctgaaggaagtgatatgactattgcttatggtgttaaagggtactttggagaagttgtatctaaggaagttttttttccggaagtagagtatttgttcgaggggaagtatttctttggaccaaatgatgctagtgcatatctgacaaaccgttatggggactatatgaaactccctaatgctgacgagcagattgaacgtcatattcggttaagagatgattgggaagagcgagtaaagaggtaacaatgagtatactattatgtctaattatattattattggtatatttttattttttatcagtaaagaaggatttatctaatcctggaattattaacttagcgatttggctatttgcttcacttgggacgatacatttttctaatcgatggggaactccattaagttttgcaactctaatcatattagtatctggactagtgatgttttcaacaggtgtactttcttcaagtttaattgtgagaacttcgaataagaaccatttaataaagttgcctccagtttcaatgcttttttttgtcattgtagttattttttttattttttcttatcaaatcttatctgatgatgcatttagagttgcgacctattattctcaattatctggtaaaccactaagttctgatttatttactgcaattgaacgtgccagatatatgattaccaattatgactactcattttctaaggggacagctaacttgcttagagcaaactattcacttggtattttagcttttacttacttctgccaagagttcttttatggaaagaaacttagtcataaaattttatttttaattatttccctctggacactgttcatctcacttctttcaactggtagaactgaattattgggacttgtttcaggatattttgtgatttttaccttatattattccttcaagtacatatggtctggtatcgaatcgtctgggaaattattaaaaatcattttattgtatgggttaggctcaataggattatttcttttagttggtgaatttgttttaagtcgattgggaaatagtccaatagataatttatcgaaatatattggttctccgatagctggattagattattttataaaaaatcaaaatttttacgctgaaaataggtactttggtgaaaatacctttatagctatttatggaacattaaagtctttgggaatttttcctgagagactttcaccatttttaccaataataaatttttatgggactacgagtaatgtttacactgcctattatgttttcataaaagattttggatattttattgcagtcgttgttcaattcttatatggtttattttttggcacgatgtactatatcattaaaaaaaatctattttcaccacttttaataatgctgtatggactattatcgtatggaatggtgataatgtttttccaagaagcatttgtcacattgttgacaacacatattatacgtgtggtcttcttattcatgtggtttctgttaataaaaatattatctgtatttaaattaaagaggtatagatagcagtagatgattgtaaatataggttccatagttacaaggggaagtaatgaatttgctaaaaaaaataagcgtctttaaaaaagtttattcaaaagtatatgatagtggcagaatctaccaattattcagcaatagattagttttttttacaggacttcaacttttgcttcaacctaagaccaaaaaatcgttagagattttacaagtttccattgatcaaaaaatcatgcgaaaactacgaaagaaatataaggccgatattgaatattttaagaataatattgatagttttaagcaagaagagtttaggcctagcgatgataaaagcatttgggttttatggtatcaggggatagagagtgcaccgtttttagtcaaacaatgccttgagtctctaaagagaaatctacctaaggatcgacagctagttactttagataaaatgactttaaatgactatatcaatctcccttcttttatcatggaaaagtataaagcaggtaaaatttctcatgctcacttttcagatattgttcgtattgaattactatcaaaatatggaggaacctggatagatgcaacagtctttatgagttcccctgttattcatgactatttctttgattctgatttgtttttatttcaagaactacggccaaatacgttcggccatagtaggagagtatctagttggtttataactgctaaaaaaaataatgagattgttttgttaactagatacttaatgcgtaaatattgggaagaaaataatagtttgatagaatatttccttcttcatagtttatttgaacttgcaattgaagcgtatcctaagatttgggagacagtcattcctttcagcaactctcatcctcatgttttgcaatttaaactgtttcatccgttcaatgattaccattggcaggagattcgtaagttagtagaagttcataagttgacttataagtatgaagagaaaaattataacggaacatatctcaatgaagtagttcttaagtgataataaaaaggaggttgtatggtagtctcaacagttatttttgcgggtggttcgggttcaaggatgaaaaccactaccaaaccaaaacaatttctagaattgcatgggaaacctatcatcattcacacaattgagcattttgagaatcatccgctgattgaccaaattgtcattgtgtgcattgaggggtggattgattatttagaaacgttgctttctaaatatcaaattaagaaagttaaaaaagtagtgccaggtggaaaaactgggcagatgtctatctataatggccttgaagtattgtctgaaagtgtacattcggaagatattgttctcattcatgatggtgttcgtccactgattgatgcggacactattacgaataatattgaatgtgtgagaaaaaataggaccgctatcaccgttaaacctgtaatagaaacggtaatccaagttgatgaaaataatgcgattaccgatgttgttgatcgtgactcctgtcaaacagcagttgcccctcaaagcttttatctgtcggatattttatcgctacatttgaaagcacaagaagatggcttgacgagcatgacagattcagcaacattggttcgccattatggcttagaattgttcactgtgatgggaggagcagagaacattaagattacaactccatcggatttttatatttttagagctatctatgattcaagggagaatgctcaaatttttggataggaaagtagtatgttggatccaattttagaaaaagattgtgttacttttgtaaaagagaatgaaaacctattatacgaattgaaaaataaaacggtgtttataacaggggcaacaggcttgattggcagccatttagtttattcgcttattttttcaaatcgtttgttgtgcactaacataaaaatagttgcagcagttcgttcaagagaaaaagcggaagacaagtttgcagattatttagacgatattgaacttcacatttcagatattgggcatgtgcaaaattatgaaggtgacattgattttattattcacggggctagtgttacagcctctcgcgattttgttgaaaagcccgttgacactatttttactacattaaatggtacaaaaaatattcttgatttggcaaaagaaaaagcagttgataaagttgtctatctatcttcacttgaggtttacggaacaaatgagaatagagagtcaatatcagaaaatgattacggatatatagatttcacacaagtaagaagtagttactctgaaggaaaacgaatggcggagtgcttatgtgtatcatatgcaagtcaatacaaagttccagtttcgttagcccgactaactcaaacatttggaccgggtgttgactatcaagacaatcgtgtatttgctcagtttgcacgtgcggttattgaaaggcaaccaattactttacatacaaaaggtgagactatgaggagttactgctatacaaaggatgctgtagctgctattttttacattttagtcaaggggcagtctggagaagcatacaatattgcaaatgaggaaacttatatttcaatctatgatatggctaaattggcaagtcagctcgattcaagccagtcatgtaaagttaatatagaattacaagatatcaatcaattgggctataatccaaccattaaaataaatttacagacgcaaaaaatcagaaaacttggctggagtccgacagtgggattaaaggggatgtaccaatcactaatctcttctatggagagctcgtttagggagtaaggtgaacaattgaaaaaattattgttaaattctagctatgccatcatatcgaatctattgtcgctgtcggtctctactctagttattcttattttacctaaattgataggagtggaggaatacggctactggcaattatatttgttttatacaagctatgttggatttgctcatttagggtggattgatggaatttatcttaaatatggtggcgaagagtatgaaaaacttgacaaacaaaattttttctcacagtttatttcatattctatttttcaggtagttattgctgttattatttttatcgtaggtaatagtgtagatgttggaagtagtaaggagtttatctttaatatgctttcattgaccttattagctaccaaccttcgattttttgttatttatattttacaaacaactaatctaattaaagaaggcgcaagaataatgattcttgataggttgttgtatgttctttttctgatattattgattataggtggtatttacagctatcgcttaatgatagtagttgatgttatcggacgtttcctttccctactttatggtatttatttatgtcaggacatcgtaatacaaaaactgacgaattttagacttaatatttctgaaattgttgataacataaaagtcggaagtaatttgatgctttcaaatgttgcaagtatgttagtaattgggacggttaggctaggcattgagaagcactgggatgtttcaacttttggtaaaatttctttgacgctcagcatttcaaatctagtcatgacattcatcaatgccattggaatagtgatttttccgatgttgagacggacggaagagagggcattgccaggtttatacgtaaaaataaggaatatactgatgcctgttttacttggtttcctactattatttttcccacttagggcagctttaatgatttggttaccgaagtatacagatagtttactatatatggctcttatttttccgatttctgtttttgaaggtaaaatggctttattgatcaatacatatttgaaggcttatcgcatggagaggacaatattgtttgtcaatttgctgagtatgttactgagtatgctgttgacattcatctcggtatttgttttttctaacttaattctagcaactctttctattacattcttattgttctttcgttgtttttttgcagagatattgttgtctaaaaaactttctatatcaattttatcggatgctttaacagaggcagttattgctggcttatttattataactgcatggattcttccgagtttagttggtttcttggtgtatctaattgtatataccatttacatttgggtaaaagtttatagaaataaaacttttacattgagtctaaagtagtataaattagagtatcctgttaaagtttgtgttgaatgattcaggagctatggagtaagcattgaatgtcaaattacgattatctaattgttggtgctggtttgtttggtgcggtatttgcacatgaggcagcaaaaaaagggaaaaaaataaaaatcattgagaaacgagatcatattgctgggaatatttatagcaaggaagttgaaggtattcaggttcatgaatatggcgcccatattttccatacatctgagaaggaaatctgggattatgtgaaccagtttgcagaattcaaccgctatacgaactcaccagttgccaactataagggggaaatatataatttacctttcaatatgaatacctttaataaactttggggtgtggtaacaccggcggaggcggaggcgaaaattgctgagcagcgtagggttctcggtggaaaaacacctgaaaatttggaagaacaagctatttcactcgttggtacggacatttatgaaaaattgattaagtcttatacagagaagcaatggggaacatcctgtacagagcttcctgcttttattatccgtcgcttgcctgttcgcttgacttatgataataactacttcaatgatacttatcaaggcatcccaattggtggctatacacagattgttgaaaaaatgcttgatcatgagaatattgatgtagaaacaggtgttgatttcttttctcaaaaggaatattaccttgccaattatcctaagattgtgtttactgggatgattgatgaattttttgattatgagcttggagaattggaataccgtagtcttcgttttgaaacagaagtgctagatatggacaattaccaaggaaatgcagttgtgaattatacagatagtgaaacaccatttactcgtatcattgagcacaagcattttgactttggtaatcaggcgaagacaattataacacgtgagtactctcaaacttggcagcgtggagatgagccgtattatccagtaaataatgaccgtaataatcacttatacacagcctataagaaattggctgagaagcaaaaaaatgttatatttggtggtcgtctaggacactaccgttattatgatatgcatcaggttattggtgctgccttgcagtgtgtgagaaatgaagtcaattaaaagtgatgtgttaggaaattaggctatgaatggagggggagctctctaatttagcctgatttttttatttgaaaaaactataatatatttcccctctctttctgaacaaagaactagaaattatatctactgcttatcaagaacagataaaagccctctctcctcctagccttgttagatggggatttaatgagctattgttctgtatgtgaagtacaaaatgagtctggggcaaaaagattctcaattttgaaaatctcaattatcaagtcctttagatctataattgaagaaaaaaagcaaacaaaactagttttctgacaatcagaatcttggtttgttcgctttttatatatgagattggacgattgtcccaacctcttttatttattgaatagctgctaataagtcaagagcttgtttttcaagttttgcgagggtttcttcggacaattccaatgtaccagtgccccatgcttctggattgatggttgaacctgtgaactcaccgacaatttgagtgcggatgaaggggagcaggtgttgaaaatctttaaataggtggtcatgtccactgtttgcgactgccgatacagtcgtaattttatcttgaaggatggatggaccttttggatctgacaaatcaagtgaacggctgagccagtctagggcgtttttgacaatgcctggtatagcatagttgtagactggagagaaaatccagatggcatcagcggtacccacttgtgcacgaagctcagaaatttcagggagaaccggtgtttcactatcttgattgaataagggaattttagcaagatcaatataagacacttccgccttgtcggtcaggaatgcttctgctttttttgccatttgatggttaaaagagccttcacgtagtgaaccaactaagaataatacatttgccataatggtatttgtctccttttgaatagataaatgtatggtttgtaaaaatcaaccgctggagctaccaacttgacagaatacctcctagctctagctatcctttgattttcactgagtattagtatatcgtatttatctcttgttgacaatgctggacttactgcttcttgaattttttaagaatcttagctagttgctcttgttcttctaagctaaggacagaaaaaatttgcccgatatggtcgtagtgttcaggcaagatattttctatggtttttcgtcctaatggggtaaggcaaattagtgaggcgcggcgatcgtttgtatcaactgttttataaatataaccatctcgaatcatatttttgataacaacagtcatattaccagaggtacttagcaacttatcgattaagtcttgaatgcgtaaatttcctttgttatagagcgcttccattactccgaattggcagactgtcaatccatgtttttttatggtttccaattcagactttgagatggtattggcagctctgtggaagacgactaggctatggagtgcctgcttgttttcgtgtaaagattgttcaacagttttcatgagaacattttagcaataaatagttcgcttatcaagcaaaaaaagcaatattcctctttcttgtactacatggaatgaaaattatcttgtaagaatggaaatcttgcctaagttatagtataataaggctattatggaaaaaaagattagtcaacttttggaggcaatgtcaacgaagaaagggcagttattggtcggttcgttcattctccttagtgtcattactttttcgatatttgtcatctgggatcttgcggctaagcccttttctgatgtgcgttaccatgctattgcagtggctaggaagtatgcggatttacagtttgtcaaagatttttctgtctataatgggacggagacctattttagtctgcgaggatcgacaagtaaaggtgagtcaatcgcagttatcgttccagaagcaacaaatactgtttacgtttatacactagcaaatggtatttcagaaagccaagcgcaggctattgctcaaaaaaatggagcaggagaaagggagcgtatagtccttggatatagagatggtgagccgatttgggaagttaaatctggcaccgcctattatctaattgaatttgaaacaggaaactttatcaagaaggaggggttatgagcaggctttcaaagcgtgtcctagacatggaagagagtgtaacactggcagcaggagcacgtgctaaggctctgaaagccgaggggcgtgacattttagagttgactttgggagagccagattttgtgactcccagaaatattcaggaagcagccatagcatctatagaaagtggaagggctagtttctatacagtggcttccggacttccagagttaaaggatgcggtcaatacttattttgagaacttctacggttattctattgatcgaaatcaagttgttttagcgacgggggcaaaatttgttctctatgctttctttgcagcaatcctcaatcctggtgatgaggtgattattccaaccccctattgggtatcttatgcggatcagattaagatgaacgaaggtgtgcctgtctttgtcactgcgacagaggagcacaattttaaagtaacagtggaccagctagaggcagctcgtacagctaatactaaggtttttcttctcaattcgccatcaaatccgacaggaatgatttatagtcgtgaggagcttgaagctattggtaattgggctgtggaacatgatattttgattctggcggatgatatctatggtcgtctggtctataatggtcacaccttcacaccgatttccagtatctcagaaagcattcgccagcagacaatcgtagtcaatggtgtagctaaggcatacgctatgacaggttggcgggtcggttttgcggtcggtaatcctgagattattgctgctatgagtaagattgtcggccaaacgacttcaaatttgacaaccgttgctcagtacgcggctatcgaagcttttacaggtccgcaggatgcagtagaagctatgcgacaagcttttgaagagcgactcaatacgatttatcccttgcttgcagaggttcctggatttgaagtagtcaaaccagaaggggccttctatctatttccgaatgtgaagaaggctatggaaatgaagggatatacggaggtgactgagtttacgacagccatcttggaagaagtcggagtggcgatggttacgggtgcaggttttggtgctcctgaaaatatccgtctcagctatgcgacagatatgagtaccttgagagaagccattactcgtttgcatacatttatgaaaaattaaaaaaagaggaaaaaaatgtctagaaaattgattacgattaaccaagtgaaagattatgttggtcaagaagtgacgattggcgcctgggttgctaataagtctggtaaggggaaacttgctttcttgcagttacgtgatggtacggctttctttcaagctgttgccttcaaaccaaactttatcgagaaattcggtgaagaagtcggtggtgagaaatttgatacggtgaaacgcttgagccaagagacatcagtttatgtgacagggactgtcaaggaagatgagcgttctaaatttggttatgaattggatgtgacagagatagaagtgatcggggagtcacatgattatccgattactccgaaagaacacggtacagatttcttaatggataatcgtcatctctggttgcgttctcgtaagcaggttgctatccagcagatccgtaacgcgatcatttatgcgacttacgagttctttgaaaagaatggttttattaagtttgatagtccgatcttatcaggaaatgctgcggaagattcaacagaactctttgagacagattactttggtacaccagcctacctcagccaatcaggtcagctttaccttgaagcgggtgctatggcacttggtcgggtttttgactttggtccagtatttcgtgctgaaaaatccaaaactcgtcgtcacctaacagagttttggatgatggatgctgagtattcattcttgagtcatgaagaatcacttgatttgcaagaggcttatgttaaagcacttatccaaggtgtcattgatcgtgctcctcaggcattagaaacgctggagcgtgatgtggatgctcttaagcgttatatagctgaaccatttaagcgtgtagcttacgatgatgctatcactcttcttcaagagcacgaggcagatgaagatacagattacgaacatattgaacacggtgatgactttggttcaccgcacgaaacatggatttcaaactactttggtgtaccgacatttgttgtcaactatccagcaagctttaaagcattttatatgaaaccagttcctggtaacccagagcgagtgctgtgtgccgatcttcttgcaccagaaggctacggtgaaatcattggtggttctatgcgtgaggacgactacgatgccttggtggctaagatggatgagctgggtatggataagacggaatatgaattttaccttgacctccgtaagtatggttccgtgccacacggtggttttggtattggtatcgagcggatggttacttttgtcgctggtacaaaacatatccgagaagccattccattcccacgtatgctacaccgcttgcatccataa

SEQ ID NO: 67 - DNA, 23642 bp, Streptococcus suis
aggatgccgtatgctttaacaatgttcgggggatgcttggctatacaggaacttataaaggtcaccgtgtttctgtaatgggaacaggtatgggaatgccatccatctctatttatgcgcgtgagttgattgttgattatggtgttaacaaattaatccgtgtcggaacggcaggttctattgatccagatgtccatgtgcgtgaactggttcttgcccaagctgcagcaacgaattcaaacatcattagaaatgatttcccggaatatgattttccacaaattgcggatttcaaacttttggatactgcctaccacattgccaaaaaactagggatgacaacacatgtcggtaacgtcctgtcatctgatgttttttactccaatatgccagaacgtaacatgaaactaggaactcttggtgtgaaagctattgaaatggaagctgccgctctttactatcttgcagcccaacatcatgttcaagcacttggtattatgactatctctgacagtcttgtccacccagaagaggatacaactgccgaagaacgtcaaacaactttcaccgatatgatgacagttgggctagaaacgctcatcgctgactgatgtctcacaactatgaacacatagacatcctcttggatgtctatgcttataatcacgcttggaaaatcgcagagcaagttccaaattttcctgagcaaagcctctatcttctggaaatgctgaaagagcgcagagagttgaacattgactttgtttttaaacataggttagaaaatcaaacaattaaagacttttacaactttgagctgatttctaacgcctatgaggaagaacttttagccaattatatctttgatcttgaagccaaggtcaaaaatggagaaatcatagactttgtccgctcagtcagtcctatcttgtacagattattttttcgcttagtgcaaaaagaagtaccagatatcagacaatttattcatgatgccaaaaacgatcaatatgatacatggcttttcttgaaaatgaaacagagtaactaccaaatttttaatgactaccttaaaattcgccgtgatggtaaagtaacctctaaaagcttggctgatttcttacaatttactagccttcctaaacctattaagaaattaattttggaacttagagactttgaaaaatctgttcgcaatccacttgctcaccttatcaaaccctttgacgaagaggaattgcatcggacaacaaacttctcatctcaggcttttctaaataaaatcatagatttggcaatctttgctggaatacattacgatcggaaacacttttattttgacagagttaatgctatcatcaaagagaatctagctattgataatttttaacaatctaacataaacagaaagttattatagtatgcctacacaagagactttacatccctacaaaaagcgccattccagtttagttggagtggcgcttatatatattaatgccttaattttttcaaaacaagccagtcaggcaaggtttcgagtttcaaggaggattagattagtcggcatcgaatttaacctcttcaagtaagtattcaataaagcgctctcccatcttagaaagattggctttttcatgacggatatagacaatatcaatcatatcttcaacatcaagtgggatagacacgatattgtcgccgttgaggttgctattgaggatgccggttgcagttgtgtacccatccagtccaatcaaaagattgaacaaagttgcgcgatcgctcacgacaatagactttttgtgaggaatctgggacataatttcttctgaaaagtagaaagaattgtgaatcccttgatcgtaactcaaataaggaaaatcttccaagtcttcaagcgaaaccatctgacgatcagctaaaggattgaatttactgacaaaaatatgaggacgtgccttaaataaactcgtgtaggtcaaatgactatcatcgaacaacttagttaggacatcgcgattatagctgtttaaaaagagaactccgatttctgaacgaaagtttttgacatcatcaataatttcgtaggttcgtgtctcacgcaaaaaaagctcatactgagacatatcagttccttttaacaaggaaacaaaggcgttgacaacaaaagcatagtgctgagctgatacgctgaaaagttcacgcgtagtcgtcttacttttataacgctcctccagaagtgctgtttgctcgatgatttgacgagcgtaggataaaaattcaacaccatccttggtgagagtgattcctttaggattacgaataaatatctcaattcccatctctcgctcaaggtcacgaacggcattagaaagactaggttgagtgataaacagctgtttggcagcttcattcatacttcctgtttcaacgatttttataatgtagtgtaattgttggattctcatagcattagtttagctcaaaagtccaattgtggcaagcttttagaacccttttaataaaaaaagaagcatattacatttgtcatgaaaatgtaacaaagactgtcagaaagtttctaacttgtcatgaaatactgatttaaaggggttttggaaattatttaaaaaattaaaaaaactgtaaggatttttaaggaattgaaaaaatgtgagttaaatggtatattagactatggattaagatatatttaagaaatggggactgtaatgaccaaacgttcacaaagtcgaaagaagtcgggtaaagtatctgccactgccatgattatcaatcttgccttgttagcactcttcactgttttagggggagttgttatctatatgacttatcgatacaattttctggtcttccataatatcaatgtcatttatacaggagttttggttgctatctttatcttgagccttctcgcaatcatattcaagaaagctaaggtactaactggaatcgttcttgtttttttcacaattttgacaggtgtgacacttttcggatttaaatcggctattgatgttactagtaagtttaacgagacagcttcctattcagaagttgagatgagtgttgtcgcattagttgatagttcactaaatgatatttcagaagtaacaagcttgcaagcacccacaggagctgacaagaataacattgacgagttgatgacacaaattcgtatagacaaaggtttggaattgacaccagaatctgtagaatcttatcaagtggcctatgaaaacttgaaaaatggcagcagtcaggctatggttctcaatagtgcttactcaagtcttttagagatgaactatccagactacgcctcatcactaaaaactctttacacttacaaaataactaagaaagtgacgagtgacgccaaacaagcaaatgctgactctttcaatatttacattagtgggattgatacctatggctcaatttctacagtatctcgatcagatgtcaatatcattttgactgtaaatatgaatactcataagattctattgacaacgaccccacgggattcatatgttaaaattccagatggtggaggcgatcagtatgataaactcacacacgcagggatttatggtgtcgaaacttctgagaagacactcgaaaatctttatggtattgatattgattattatgcacgtattaatttcacctcattcttaaaattaattgatcttgtaggtggtgttgaagtttataatgaccaagcctttacaagccttcatggaaactttaattttccagttgggaatatcactttgaagtctggagaagaggcgctaggatttgtccgcgaacgttactcactacaaggtggagataatgaccgcggtaagaatcaagaaaaggtcattgctgctcttgtgaacaagttagcttcgctaaattcaatttctaacttctcagctattatcaatggcttacaagattctgttcaaaccaacatgccactagatgcaatgatgactctggctaacactcagttatcatctggaagtaagtttactgtaacctcacaagcagtgactggggcaggatcaacaggtcaattaacttcatacgcaatgcctacagctagtctttatatgatgcaacttgatcaaacaagtgttgcaacagcttcacaggctatcaaaaacacgatagaaggaaaataagtatgattgatattcactcgcatatcgtatttgatgttgacgatggcccagatacacttgaagaaagtttagcgcttattaaagagagctattcacagggcgtcagaacaatcgtctcaacatcacatagacgaaaagggatgttcgaaacaccagaagaaaagatttttacaaatttttcagttgtcaaagaagaagtcgaaaaaatttatgatgatttgacactttgctttggtggagaactctactacagcaatgatatcccagaaaaattatctaaaaaccaagtacctcggatgaatgggacacgctttgccttggttgaatttagtatgacaacaccttggaaagaaattcatacaggactcagtcaagtattgatgcagggagtaacacccatagttgcacacattgagcgctataacgctttggagttcaataaagaacgtgtcaaagaactaattgatatgggttgttatactcaaatcaacagttcacacgtgcttaaaccaaaactttttggagataagtataaagtctttaaaaagcgtgcacgctactttttagaggaaaatttggttcattgtgtcgccagtgatatgcacaacactggtgagcgtaaaccttacatgaaagaagcttatcaaatcatttttaaagattttggtaaaaaacgtgcccatgatctttttaaagataaccctcaaactttgttagaaaataattatctataaataggagaaactatgaacacgaaagacaatgctagtattgaaattgacgttcttcagctcttgaaaaaactttggagcaaaaaatttctaattatctttgtagctttattctttgcaacactcgctcttttggctagtatctttttgcttaaaccaacttatacagccacaacgcggatttatgtggttaatcaagccagtgaaaacaatatcacaagtcaggatttgcaagcgggaacctatctggtaaatgactacaaggaaattatcaagtctgtagaagttttgtcagatgtactggcagaggaaaaatcagacctgtctacggcagaactctctaatatggtatcagtttctattccaactgatacacgtttgattgctatttcagttgaaaatcaagatcctaaggaagcagcgaaattggctaacagcatccgtaagctttcttctgaaaaaattaagaatgttactaaagttcaagatgttacaacacttgaagaagcagaagttccagataaaccctcttcaccaaatatcaagcgaaatgctgtattaggtgctatagtaggagtgttcttagctgtcgtaggtgtactacttggcgaagtcttggatgatcgtgtccgtcgtgcagaagatgttgaggatattttaggattgacattacttggtatcgtgccaaatactgataagatgtaaggagagaagaaatgccacaatttgaacttgtgagagcaaaagctcaaatgtttaaaaagaccgaggagtactacaactctatccgtactaatatccagtttagtggtcgagatttaagagttttagcgctgacctcagtacaacctggagaaggaaaatctacgacatctgttaacattgcggtttcttttgccaatgctggcttccgtactcttttgattgatgcagataccagaaattctgtgctttctgggacatttaaggcaaatgaacgttatcaagggttgacaagtttcttgtcaggcaatgcagaattatcagatgttattggtgacaccagtgtgcctaatctgatgattatcccatcaggacaagtaccacccaacccaacctcactgctacaaagccaaaatttccaaagaatgattgaaacgattcgtggtctctatgattacgttattattgatacaccaccagttggattggttattgatgctgctatcattgcacacaatgcagacgcgagtcttttagttactgaggcaggcgccatcaaacgtcgctttattcaaaaagccgttgaacagttggaacagagtggtacgcaatttttaggtgttattctgaataaagtggatcagacagttgataattacggtaactacggtgattacggcagttatgggaaacaaaataaagaaaagaaatctaaaaaagcgaaaaaatctaaatcaaaaattaaaaaataagaataaaactaaaaataaataaaaaattaaaaaagggggggcaaatgtatacagaaaactccaaagggaaggtttcttttttattaacagacatcttttctgtcttattaacttattcaatcttatctctcaattactcctatacatttttttcaagtaagttttttgttgccatttattgttttttgattgttacagttgctgtttttaccgatgaatacagtgatgtcttgcaacgtggctatctcaaagaacttaaaaagtccatcttttacggaatcagagttttatcacttttttcgatggttttgatgttcgggaaatatcgcttcattacggatattttcaatatttcctaccactttttgcttgaagttctgttcctttcgatgcttttggtttttctaggaaggtgttttgtcaaatatctttttgggaagcaccctatggagattaagaaagttctccttttgaccaattttgaatcggatgatttagaaaaaagacttgcagaaaatagctttgaacttgttggttatatcagtcataaagataagatagacagtatagtgcctatcctaaaaaatatgaacgatattcgaaactttattgctgagaatgttgttgatgaaatctttgtagattcagactcacaggcgaattatattgatgaagctaagtatttcaaactattggggattccgacaaccttaaatcttgggaattacaacaattactatgcaggtgatgctgtcattaaaaaggttggtgatttgtcgtgcatgactacagcaatcaatattgtcaaattcagacaactagcattgaaacgtctcatggatattttcatagcattagttggacttttgttaacgggactagttgctttgatcattatgccgattgtcaaaaagcaatctccaggtccactcatttttaaacaaaagcgtgttggaaaaaatggaaaagtctttgatatttacaagttccgaagtatgtacaccgatgctgaggagcgtaaaaaagaattaatggcacaaaatgatcttgacactaatttgatgttcaagatggaaaatgatccacgtatttttccgtttgggcagaaaattcgggattggtctattgatgaactgccacagtttattaatgttctcaaaggcgacatgtcagttgttggaactcgtcctccaacgcttgaagaatataaaaattatgaacttcaccattttaaacgcttggctgccaaacctggtatcactggactctggcaagttagcggtcgaagcgacatcacggactttgaagaagttgtcgccttggacatgaagtatatccaaggttggtcaattacacaagacatcaagatcatagctaaaacttttgcagtggtcttaaagagagaaggaagtaggtagcaaagctatttgctctcttcacagagtctataatcatggattgtagattctgtgaagaaaaataaggaaggtattatgactaaatctgtatacattattggttcaaagggtattccagctaaatacggtggatttgaaacctttgtagaaaaattaactgaaaatcagaaaaataagtctatcaaatattttgtggcttgtactagagagaattcgctaaagtcaaatatttcggatgatgtttttgagcataatggagcaacgtgttttagcattgatgttccaaacattggtccagcaaaggctattgcttatgatattgctgcattgaagaaggctattgctatctccaagcaaaacaaagataaggaacctatcttttatattttagcttgtcgtatcggtccgtttatctcaaaataccgtaaaatcattcaccaaatgggggggaaactttttgttaatccagatggtcatgaatggttacgagaaaaatggagtgctccagtacgcagttattggaaactttcagagtcactgatggtaaaatacgctgacttattgatttgtgatagtaaaaatattgaaaaatatattcaaaatgattacagtaaatttagtcctaaaactacctatattgcttatggaactgatttatcaaaatcttctttaacctcaaaagacagagttgttcgtgagtggtttgatgaaaagaaagttaatgaaaatagctattatttggttgtaggtcgttttgttcctgagaataactacgaatcaatgattcgagaatttatgaagtcaaactctaaaaaagattttgttttgattactaatgttgaacaaaatgctttttatgaaaaactcagaaaagaaaccggatttgataaagataagcggataaagtttgttggaacagtctataaccaagaacttttgaaatacattcgtgaaaatgctttcgcctatttccatggtcatgaagtaggagggacaaatccatcacttctagaagcgttatcatctacgaaattaaatctcctattaaatgttggctttaacagagaagttggagaagatggcgcactatattgggataaagatgatctgcacaaggttattgaagaaagtgaacaattgtcacaagaaaaaattgatgaaatggatgaattatcaacaaaacaagtcaaagaaagattttcttggaactttattgttgatgagtatgagcagttatttaaaggataaaaaatgaaaaagattctatacctccatgctggagcagaactatatggggcggataaggttctcttggaattaataaaaggactagataaaagagaatttgaggcacatgttattttgccaaatgatggtgtgctggtgcctgcattaagagaagttggtgcacaagttaagattatcaactatccgattttacgtagaaaatatttcaatccaaaaggaatttttgagtatttgacatcatatagtcgttactctaaacagattgctcaatacgccagagaaaatcagatcgatttgattcacaataatacgactgccgttttagaagggatttatctgaaacgaaaactcaaattacctttgttgtggcatgtccatgaaattattgtcaagccaaaagctatctcggattttattaatttcttaatggggcgtttttctgataagattgtaaccgtatcgcaggccgttgccagccatatcaaacagtcacctcatatcaaagatgaccaaatcagtgtcatttacaatggggtagataataaagtgtattatcaatctgatgttccgtctatccgaaaaaaattcgatattgcagaagacgcacttgtcattggtatggttggtcgcgtcaatgcgtggaaaggtcaaggagactttctagaagcagttgctcctatactagaacaacatccaaaagctattgcctttatggccggtagtgcttttgaaggcgaggagtggcgtgtacaggaactggaagagaacatcaccaacctaaaagtagctaatcaaatcaaacgaattgattactatgccaatactaccgagttatataatatgtttgatatttttgttctaccaagtactaatccagaccctttaccaacggttgtattggaagcaatggcatgtggtaaacctgttgtcggataccgacacggtggtgtttgtgaaatggtaaaggaaggtgaaaatggccttttggctgaagccaatcaacctgaagcactttcaaaaatgatcgaaaaattagtggtgtctcacgatttacggacaacctttggaaggaattctgtagagcgccaaaagaaacttttttcattagacagttatattgctaatttttcaaaactttataaaggtttgtaatatgaatattgaaaacataaaaaataaactaaagcccattatttatcctattattaactttgttccgcgaagacgattaaaaaacaaagattttactattatttgtgataattgctgggcaggtaaggtttatcaagaattgggaataccttatcagactccgtttgtaggtttgtttattttctcaccagattatatcaagttactaagtaatttagattactatttgaaatcgggggggggggcagcttcttagatttgttagagaatctaaatatattaaggaatttgacaatagctatccgcttgctcttttagatgatattgaaattcattttttacattataaaagtgagagtgaggcacgagaaaagtggcagcgtcgcttagcgcgtattcattgggataatctttattttaaattcaatgataatgactactgcagttatgaattaatgaaaaaattcgatagtttacccttcaagagtaaagtgattttttcatcgaaaaattatgaagatttaacgtcattggttcattttaaatctagagaaaaagaggggcatgttggtattgacctgaaaatttatcatcgatatttcaatgtggttaactggttgaataaaggtggagaggatttaagagctgattaataagatatgaggaatttatgaaaccattacttagtgtaataataccagtttataatgtagaaaaatatttaaaaagatgtttagaaagtattctggtacaatcttggaatgattatgagattattcttgttgatgatggaagtacagatagttctcccttgatatgtgattcatatgcagaaaaatatgcaatgataagagttatacacaaagaaaataaagggttatctgatactagaaatcgaggcattgagcaagcatttggagagtatgtatattttccagactcagatgattggcttgaaccgaatactttttcagaattgtctgatgttattgaagaattaacatatgacatcatttcttttaacagagaatttgttacttctgaggaagatgaggtgatttcagagaaatcacgtattcagaaattatcaggtaagcaagctctacttgaaatgttgcaacaaggggatataacaggatttgctaatgacaaaatttatagaaaaaatctatttcttgataatgatattgagttcccggttggaaaatattatgaagatttaggaacaaactataagttatttcttaaatctacgaaagtttatgtgactaaccaaaaatattatcattatttaattgcgaatccagactcgattacacaatcttggaatgagcaaaaattgaaagatatgtttggtttttataaggagatttattattcttcacttgttcgtgaaaagattgaaaaatttgaaatagagagtttacaagcttattatatcaatgggttagtacatatcttgtcaagtttgtataagtcgaatctatcagaacaatatgcggacatagaggaggatgtgaagcaagaaattacaaaaaatagtctttcgataactaaattatcaaatcaaccaaataggataaaatatctattatataagcttgggctgctaaaaattttgtttaacactcagtcaaaagtacggggagataggtaaaggctcatggggaaaacattattactgtttgagcaaattgattcatttgaacaattttttgcttcagcaatttcacactatccaaatattgaggtttctactccatataaaagagtttcttcaaagataatgcataatataagggctatttctaaaaggataccaattgaggttactcataaattttggcttgaggattggaaaaaacatttaaatgagtatagtacaattattgttttcgataatgcaattactccgagacttctagagtttatcaaaacgaatatatcagaaaactctgaattaaaaatttggctttggaatgttccaaatgagggaattggatatttgaaagaaaattttgatgtttattgttttgatcagaattattcaaaggagtatgggttaacctttttggaacagttttacattttggatagtgttaatcttgatgaaaaaacagatgtattgcgagatttttattttgttggagctgataaaggtcgtgtaaaacagttagagcaattagctagcttgattgaaaaagcaaagttaacatatttgtttgatatttttagtgaagaaaagaattcaaattacagtggtataaattaccttgagagcaaaattacttatcctgaaattatcaagaagattcaggaatcaaaggtaattgtagaaatcaataaaaatggacaagcaggcttaactttgcgagcattagaagcagttttttatggtaaaaaattggttaccaacaaccaccatattaaggattatgatttctataatcctaataatatccttgtgctagatgatgtgaactctgtagatttaatagaatttttaaataaaccatatcagtctgttccaaaacatgttattgaaagatactcatttagtaattggttgaattgtatgacaaaaattaataggagagaagaatgaaagtgactttttgccttcctgaaataagtcaagtccccatgggaggctataaaattatttttgagtatgccaatcgattgcaagaaagagggcatgaggtagccattgtctttttaactcacaatgtatggagtcgcctaaccagcaataataagattaaatcaatagttgggcgtattagagggcgtaatgaaccatcatggttttatttgaatcctgctataaaaaaaataatgacgccttatttagatggcagagagtttcctgacgcagattttatttttgcaacggcagtaacaacagctggaattgtcaaaggcttaccctctcgatgcggtaaaaaatgttattttattcaagattttgaaacatttattctccctgaagataaagttgttgaaacttatcaatacgactttctaaattttaccgtttcaaattggctaagtgatattgttggagtatatacaagtaataaaccgatatgccttccgaatcctatagatactgagaattttagagtgatcactcctataaacgaacgaaatcctcatactttagggatgctttatcatgagggagaacataaaggaattccatatgccttggaagccattgatatagtcaaaaaaaaatataacgatgttgtagttaacatttttggtgtaccaaatcgtccagcaactttacctgactattttaaatatatacagaatgccaatcaaaaagatttattaaaattatataatgaaacttcgatttttgtttgtgcaacaattgatgaggggtttggattaacaggtgctgagagtatggcctgtggttgtgcattagtttcaacagcttatgacggtgtttttgagtatgcagaaaatggcgtaaatgctttactatctcccgttagagacagtgaagcattagctgaaaatatcataaaactgattgaaaatgaatcttatcgtcagtcattagctcaaaaagctagtgagatgataagggagaggtcgtgggataaaacaattcagaaactagaaatagttttggcaagagaactaggtgtgaacagaggttagtatgattagaatagagaaagtaataaatttctttttttacattagtgttattttatatatgttttctttgtctaacattcgatttttttttcatacggagtatgtaaatattataccgaccgtcttaggcttacttgcttatatgatgtactattataaggttagagaactaccaactaattcaataccgtcattactattgttaacactgtatattatatttatagtatttttttggaaaaaaattgatattgactggtcgctattaagtgtgctgatatatgtcccattgattgaacctggaaataaaagtttcattcgaggacttctgttaattaaattatttgtattggtaattgtaatagtgttgtctctttttggattgataaacgatacatcatattttaaattgagtggtgtcagtcactcacttggtttttttcatcctaacacattaggggcagtcagtttatctattttttttgactactttatattatttaaagatttaagaaaacaatattttacattttttcttcttgcggtgttatatacgctatatagattaaccttttcaagaacgtcaatcttaatagttggaatagggctgataatttatctattccgaaggagactgtctcaatatgtaattaataaatttgtatttttgatttgtgctactggaatttatcttttcggaacattgtattcaatgttttatagctcctccaatattttctacaggcaattagatgtctttttaactaatcgagttaaattggggaatatgtacattcagagatatggttttacgctttttccaaaaattactcctaatatcatacctcaaggttggtggagtgtagatcaactttttaatgataatacttttctgaaatttacgcttacacagggagtgattattgctacactatttttgctctatattttatatattttaagaaataatgagtatcgtttgtacaatgcactacttatcctactgacattcttattcttaataattgaggctcagggattttatgtattcttattaacaccactacttctcaagtttatggctattggagatgatagtgtgaggcaaatataaaaaatgttattgtaacattttcaatacgacaagggtattttatgaagacagtaaaaaactatatttatagttcactatatcaattatttttaattattgttccatttgtaacaattccttatgtatcacgtgtcttgggtgcagacttaataggtattaattcgtttacgaatacaattatgacttattttgtactcttttcaaatttaggaacaactgtttatggaaatcgaacgatagcttattatcgggattcagtagctaagcgtagtcaaaaattttgggagattattattctgaaattagttgtctcatcatctatttatctcatgttcttagtttttatttggatatacccgaagtatcgagtggtttttatgatacaatctatccaaattctggctgcagcagtagatatttcatggctatttgatggtttggaggattttaagcgtacagttgttcgtaattttatcgtgaaattatcatctgtaatcatgatttttctgtttgtaaaaacaattcacgattttaatatgtatgttttgataactgtgggtgcaactttagtgggtaatttaactctttggacatacttaaaacaatatattacaaaagtttcgtttactaaattgaatatatcagagcattttgtacctgttttctctctatttgttccacagattgcgtctaccatttttgtttctttaaataaagttttattgggtgctctttcgacgatgtctcaagtaggatattttgaaaattcggataaggtagttagaattttattggctctagtttcgtctattggagttgttgtttttcctaaggtagctaatgcttataagaatcgtgatgttgaaaaggtgacagagttgacaaagctgacttttgatgcagttaacattattactatcccaatggtggttgggatactatctattagcgatgttttttctaatatcttttttggcccagagtttgttgggattgatatagtactatcaatattgattctggaacttttatttatgggctattcttctgtgttgggaagtcagtatttgattgctacagggcaatcaaaatacttgagtttttccgttattggaggtcttgttaccactagtatctcatcttttattttgatttctcgttacggtgctattggggcagcggtagcatcagttataggagaagcaaccatagcaattattcagattctttgtattagaaaacagataaatatttttaaattatgtaaagatatccccaaatatagtatagctagcttattaatgtttttgggtatcactctagtaaagataatggtttcatggtcctcatatatagatctgttctctagaattatagtggggggagttatttatatgggaagtctatttttactgaggccgcaattgataaagtttcttctaaaaaaattttttaaagaaaccaattaaaaaatgagttaactaaattttcgtgaaaggtattaagtttatgaaaggtattattctagcaggtggctcggggacacgtttgtaccctttgacgcgcgctgcatctaagcaactcatgccggtttatgacaaacctatgatttattatcccctttcaacccttatgttggcagggattaaggaaatcttgattatttcaacgcctcaagatttgcctcgctttaaggacttgcttcaagatggttctgagtttggcatttccctgtcttatgcggaacaaccaagtccagatggactggcgcaagcctttattatcggggaagacttcattggaaatgatagcgttgcccttattcttggagacaacatctaccatggcccaggtctgtctaagatgctgcaaaaggctgccgcaaaagaatcaggggcaacagtctttggttatcaagtcaaagacccagaacgttttggtgtcgtagaatttgacgaagccatgaatgccatctctattgaagaaaaaccagaacaccctcgttcaaactacgccgtaaccggtctttacttctatgacaatgatgtcgtagaaattgctaaaaacatcaaaccaagccctcgtggcgaacttgaaatcacagatgtcaataaggcttaccttgatcgtggtgatttgtctgttgaactgatgggacgtggttttgcttggttagatacaggaacccacgaaagcctacttgaagcggctcagtatatcgaaacggttcaacgcatgcaaaatgtacaagtcgccaatctggaagaaatcgcttatcgtatgggctatatcactaaagaagaagtgtacgaattggcacagccgctcaagaaaaatgaatacggacaatacttactccgtttgattggagaagcataagatgacagaacaattttttgaaaaaaaacttgcttgccgtcctgtcgaaggcattccaggcatgttggaatttgatattccagttcgtggtgacaaccgtggctggtttaaagagaacttccaaaaagaaaaaatggtgccgctaggattcccagaaagcttttttgaagcgggcaaattgcaaaataacatttctttctcacgtaagaacgtgcttcgcggtctgcatgctgagccatgggacaaatacatctcagtcgctgatgagggaaaagttcttggttcttgggttgatcttcgtgaaggggagagttttggcaatacctaccaaactgttatcgatgcgtcaaaaggaatctttgtccctcgcggtgtagctaatggcttccaagtgttgactgacaaagtagcttatacttaccttgttaacgactactgggcgcttgaactcaagccaaaatatgcctttgtcaactacgctgacccagctctgggcattacatgggaaaatttggcagaagcagaagtctcagaagctgataaaaaccatccgcttttaaaagatgtgaaaccattgaaaaaagaagatttgtgaaaagagtatgaagtattctatttttgatatcagaaaaatttctaataaagaaattagagattattttgaagaggtagttagttgttatgagaacgaaaactatcgttcagcaatcttagtactctatactgttgttttatatgacttattttttaaactaagagaactaaaagatgagtattcggattcagttgcaggacaaattttggatgatatttttaatgaaatgagatcttcagatattaaatcgtcctgggaagataaattagttgagtcattgtataaacaaactgaatttgaaatactcgatgataacgtatactcaactttacaatcaataaaacagaagcgtaatttaagtgcgcatccatcgttttctggtgatgaaatttatcagccatctcgtgaattagttcttgcatttattaaagaagtgtatgacaatttattgattagaccttcaatgttaataaagaaacaagttgatataattcttacttttctagatgagcataaaggtgaatttaatgattataatttttatctaaaaaataaccaaaataatacttttttagattatttcaaaaataaatattacactaaacttagtaaatctttcaagactaaactgataaatactttatggaggtttacttttgaaaagattggagatatatatgaacaaaatagacatataaatatttttattttgggttacatttattctgaggataaagaattatttaatgaaattgttcaaagtaaagttgatgataaaaccatatacaatataatctcgcaagacacatctaaatcgtttaattattttgctatatttttatctgaaaatcctgaaatctattctttattgactgaagaacataagaaagtactagaagaaaattttagtttgtttagaggaaagtattttgtatatgaaaggtttaggtttggaaatttaaaagagtttttaaattatttaattgatagcattcagatagatgatttagataagaccgaaaactatcaaatagaatatttagctaagctatgtatcaacagtggtgaaaagaaaaagttttcacacttctgcataactaaactagaggaagttcctagctggtcaggattcgatgatgctgatttggtcatgaaaaaattaataataccaaatcatcatttatttgatgaacaggattttaataaatataaggaaattgttgaaagcaacaaccaaatatctgcaagatctaaacatgcattacagcatgaacaaattaaaaaatttgcacttgatcaaggtattagaatataaaaaaataaggagaaaagatgtttaaaaatatcatcgtaaccggtggcgctggtttcatcggttcaaacttcgtacattacgtttataataatcacccagatgttcatgtgaccgttcttgataaactcacatacgctgggaaccgtgctaacttggaagaaatccttggtgaccgcgttgagttggttgttggtgatattgcggatgccgaattggttgacaaattggctgccaaagcggatgcaatcgttcactatgcggctgaaagtcacaatgacaattcgctcaatgacccaagcccattcattcacaccaactttatcggaacttacactttacttgaagcggcgcgtaaatacgacatccgtttccaccatgtgtcaacggacgaagtttatggtgaccttcctcttcgtgaagatttgccaggtcatggtgaaggaccaggtgagaaatttacagctgaaactaagtacaatccatcatccccttactcatcaaccaaggctgcttcagacttgattgtgaaggcttgggtgcgctcctttggtgtcaaagcaacgatttcaaactgttcaaataactacggtccataccaacacattgagaaatttattccacgccaaatcacaaacattttgtcaggaattaaaccaaaactctatggtgaaggaaagaacgttcgtgactggattcacaccaatgaccattcaaccggtgtttgggcaatcctgaccaagggtcgtattggagaaacttaccttatcggtgctgatggtgaaaagaacaacaaagaagttcttgaactcatccttgaaaaaatgggtcagccaaaagatgcctatgaccatgtgacagatcgtgcaggacacgatttgcgctatgcgattgattccacaaaattacgtgaagaactcggctgggagccacaattcactaattttgaagagggccttcaagaaaccatcaactggtacacagaacaccaagactggtggaaggctgaaaaagaagctgttgaagctaactatgctaaaactcaggaagttttgaaatagaaaaaagctccacgtgagctttttataaaataataaaaagaagtgacgaaaggagtaatcacatgattttagtaacaggtgcaaatggtcagcttggaacagagctccgttatttacttgatgagcgcaatgaggactatgtggctgtcgatgtcgcagagatggatattaccgatgcagataaggtggaagaggtattctctcaagtcaaaccgaccttggtttaccactgtgcagcctatactgcagttgatgccgctgaagatgaaggaaaagaactcaactatgccatcaatgtgataggtacggaaaatgtcgctaaagctgctgccaaatacggtgcaaccctggtttatatttcaacagactacgtttttgatggtgaaaaaccagttggacaagagtggttggagacagatacaccagatcctaaaacaaaatacggtcgcaccaaacgtttaggtgaagaagcggttgaaaaatatgcggacaaattctatattatccgtaccgcttgggtatttggtaattatggtaaaaactttgtctttaccatgcaaaatcttgctaagacccatgatacgctaacagttgtcaatgatcagcacggtcgtccaacttggacacgcacattagcagaatttatgacttacttagccgaaaaccaaaaagcttttggttactatcatttgtcaaatgatgccaaagaagacacaacctggtatgattttgcagttgagattctcaaagatagtgatgtggtcgttaaaccagttgattcaagctcattcccagctaaggccaaacgcccattaaactcaacgatgagtctggctaaaacaaaggcaacaggttttgttatcccaacttggcaagaggccttgcaagagttctataaacaaggtaaaaaataagttgagagtgtgactagtcaggttactcaatctaaagttaatgctagtagagtaatgtgtcaaaaggagttatttatgaaaaaagttagaaaagctgttattccagcagcaggtttaggaacgcgttttttaccagcgaccaaggctttggcgaaggaaatgttaccgattgttgacaagccaacaattcaatttattgttgaagaggctttgaagtctggtatcgaagacattcttgttgtgactgggaagtcaaagcgttctattgaggatcattttgattcaaactttgagttggaatacaacttgaaggaaaaagggaaaacggatctcttgaaacttgcggatgagacaacaggtattcgtttgcactttattcgtcagtctcatccgcgtggtctgggagatgctgtcttacaagcgaaggcttttgttggtaatgaaccttttgtggttatgcttggtgatgaccttatggatatcacagatgagaaagcactgccattgaccaaacaactaatgaacgattatgagcagacatttgcttctacaattgcagtaatgccagtgcctcatgatgaagtgtctgcttatggtgtcattgctcctcaaggtgaaggagtcgatgggctgtatagtgttgagacttttgtggaaaagccagcgccagaggaggctccaagtgatcttgctattatcggtcgttacctgttgactccagaaattttcgatattttggaaaatcaagagccaggggcaggtaatgagattcaactaacagatgctattgatacacttaacaaaacacaacgtgtttttgcaagagagttcaaaggaaaccgatatgatgttggggataaatttggatttatgaagacttccattgattatgcccttcaacatcctcaggtaaaagatgatttaaaacaatatatcattgaactcggtaaaaaactagataagtaaaaataaattggtctgattgagaatcagccagtaatctcagaggttgtagtttagaaaagaatgatttctttgctgctagccaggaattaactatttactctctgggagattataaaatagaggaagctgggaattatccagcttttttgatgatatgtgaagctatgttataatgaatgtatgacaagctagtataaaatttccattgtggtcaattagaaagaatgatttatgacgatagatattgaaaagtaccattatttggcacaacaaaagcaaggagagcaccgtaaatttttggcatctctgaagaaaaaggctcccaaaaatctagatcagattgtccagcaagtccatggagaagtttttagggagatagattgcactcagtgtgccaactgttgtaaaagcttaggtcctctgtttaccgaggcagatattacccgcattgctaagcatttccgcatgaaattacctgtgtttgaagaactttacttacgtgttgatgaagatggtgataaggtttttcaatccatgccttgtccttttttaggggatgataacctttgtttgatctatgacgtacgaccaaaggcgtgtcgagaatttcctcacacagatcgcaagaaaatctatcaaatcaatcacttgactatcaagaatactttgacctgtccagcagcttatctttttgtggaaaagcttaaagagagaatttgaggcaagtagtaaggagaagtgggaatcaaatagaggaaacatttttaaaatagcctctgcttggttagttatctgaatgtttcattggtaaatcttactcatcaaggagaactgacaaaaacagagtgatttttgaagagtatgatataagtatgtttagtttgcttttagtacaaggtaacgggctgtaggcagtactggagtacggcaaggcgagttcaaacaatccagtggagtgtttgaagttggaaataaggaaacggagtttcctcttacgtcgaagtaataaaagataaactaattgactatactagtacagctaggcattaggatacagtgtcatgtgagtagggaatataaaaaggagccatcagcgatgtgctccttttcgcttggtctatttaaccaagttttgtaatgtttgttgcttgaaggccacgttgaccttgttcaacgtcgaatgctactttctcaccctcgtttaaggatttaaaaccatcgctttggatagctgaaaagtgtgcaaagacatcaggaccattttcctgagaaataaagccaaaacctttttctgcgttaaaccattttactgtaccttgtgacatctgtatatacctctaaatatttatttgtaaaaattattaagaggaaaacaaaagatgaaactgatactttaactctaaatcattattacttaa

---

What is claimed is:

1. An immunogenic composition that elicits an immunogenic response in an animal against *Streptococcus suis* (*S. suis*) infection comprising:
   a) a *S. suis* polynucleotide comprising the sequence of SEQ ID NO: 31; or
   b) a *S. suis* polynucleotide encoding a polypeptide comprising the sequence of SEQ ID NO: 32;
   and wherein the immunogenic composition further comprises a pharmaceutically or veterinary acceptable vehicle, diluent, excipient or adjuvant.

2. The immunogenic composition of claim 1 further comprising at least one additional polynucleotide encoding a polypeptide having an amino acid sequence selected from the group consisting SEQ ID NOs: 4, 8, 12, or combinations thereof.

3. A kit for prime-boost administration comprising at least two vials: a first vial containing the immunogenic composition of claim 1 for the prime-administration, and a second vial containing a composition of claim 2.

4. The kit of claim 3 further comprising additional first or second vials for addition prime-administrations or additional boost-administrations.

5. A method comprising administering at least once to a porcine animal an immunogenic composition of claim 2.

6. A kit for prime-boost vaccination comprising at least two vials: a first vial containing the immunogenic composition of claim 2 for the prime-vaccination, and a second vial containing a different vaccine or immunogenic composition of claim 3 for the boost-vaccination.

7. A method comprising administering at least once to a porcine animal the immunogenic composition of claim 1.

8. The method of claim 7 wherein the porcine is a sow that is about 3 weeks to about 6 weeks prefarrowing.

9. A kit for eliciting or inducing an immunological response against *S. suis* in an animal comprising:
   an *S. suis* immunological composition comprising
      a) a *S. suis* polynucleotide comprising the sequence of SEQ ID 31; or
      b) a *S. suis* polynucleotide encoding a polypeptide comprising the sequence as set forth in SEQ ID NO:32;
   and wherein the immunological composition further comprising a pharmaceutically or veterinary acceptable vehicle, diluent, excipient or adjuvant;
   and instructions for performing the method of delivery an effective amount for eliciting an immune response in the animal.

10. The kit of claim 9 wherein the immunological composition further comprises at least one additional polynucleotide encoding a polypeptide selected from the group consisting of SEQ ID NOs: 4, 8, 12, or combinations thereof.

* * * * *

UNITED STATES PATENT AND TRADEMARK OFFICE
CERTIFICATE OF CORRECTION

PATENT NO. : 10,968,258 B2
APPLICATION NO. : 16/118857
DATED : April 6, 2021
INVENTOR(S) : Paulraj Lawrence Page 1 of 1

It is certified that error appears in the above-identified patent and that said Letters Patent is hereby corrected as shown below:

On the Title Page

Item (56) References Cited page 2 'accession No. WP_044766479' should read --WP_044768479--.

In the Claims

Claim 2 (Column 17, Line 52) 'the group consisting SEQ ID NOs: 4, 8, 12, or combinations' should read --the group consisting of SEQ ID NOs: 4, 8, and 12, or combinations--.

Claim 3 (Column 17, Line 55) 'containing the immunogenic' should read --containing an immunogenic'--.

Claim 3 (Column 17, Line 57) 'containing a composition' should read --containing an immunogenic composition--.

Claim 4 (Column 17, Line 59) 'vials for addition' should read --vials for additional--.

Claim 6 (Column 18, Line 41) 'of claim 3' should read --of claim 2--.

Claim 9 (Column 18, Line 48) 'an' should read --a--.

Claim 9 (Column 18, Line 50) 'SEQ ID: 31; or' should read --SEQ ID NO: 31; or--.

Claim 9 (Column 18, Lines 54-55) 'further comprising' should read --further comprises--.

Claim 10 (Column 18, Line 63) 'SEQ ID NOs: 4, 8, 12, or combinations' should read --SEQ ID NOs: 4, 8, and 12, or combinations--.

Signed and Sealed this
Twenty-third Day of May, 2023

Katherine Kelly Vidal
*Director of the United States Patent and Trademark Office*